United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 19

SEQ ID NO: 32 - DNA, 3690876 bp, Anaerostipes Caccae (residues 1-1,845,438 of 3,690,876)
  misc_feature (2192545)..(2192546): ">" designating noncontiguous sequence of whole genome
cttattcggtatccccgtttgctggtatgctcactgcggatacgtcataaacctttttaatttttaaaatcgtcctcgtgcgtgttactctgtcgtatgtttcctctgccacggtaaacgcccatgacattttagtaatcatgcctgcttcaatgtcctgatacaacccacgggctaaatctgtctttcctaaatcagccgctactaaaagccccttatggtctggcactaaaataagcgtcttatttgactgtctggcaaataccctgcctgcatggtcgtactgcatgataacgtcgctcatgtctgcgccgtccagtgcgtgtgcgtctattctttcgtaaaactttgtcccgtcctcaaattcataaagcaggtacggcttgtcaaaagttgtagcgtacccctctacgtaatagtctgtatctattcttttggctgctgcctgcgcagtcagcggcgctgccagcgccctatattccctctctttcttaatcggcattatttacaccctctttctgtttcccgtcgtctggcggctctttcgtctcgccctctgttggttcttttccctttccgtcgtctgtaccctgctgccctgcctgcggtatctgctgtatgataatctgcggctctttgttgctgttgttcagctcgcttacttccgtatattcctttcggatataatacttttccccgtcctctacgtgtgacatattccatatatccattaccccgttacggttcaacagcgcacggtcaaaaagctgtgtacttacttgtagctttgtagcgttgctggcatattgcaggcggtttgcagaaaaagtaatagcatttccgcacgctatctctctgtcagaaaacgtcatgtttgacataacaagtgaaagctggattgcaaacggttctatctttccctcgtagtatgcgttccacgtttcctcattgaatttgttttgcaaaatatccatgttcgtgccaaaatgcgtgcatacattctcttgtatgttctgcatctgcaatgcgtttggcgtgtacggtttgctctctacttgtttcagctctgaaaacttattatcataaataatcattccgctgtcattgtcggcgcttaaattgtcctcggtaaaccgttcccgctctttcctaatatcctctggtttcagcatatttgccacctttgccagaaagcggatatttgcagaatttttaaacggcatttataatgccctcattctgcgtatgtatcgctgcatagtcggcttaagcgttcggtatcctctccaaaaggtcgtctgtatattcaaagtcggttatgatacctactttttcaaattcgatagccccatgctccccgtttgcaaacagataccgtaagtaaacctgtccttttacctctaccacctcgcagcgctccgcacgcagcgatacccagccgcatagcctgcctaatttgtcctcaatcgggcacaataaaagcggtatgctctactgctacgtaggtcgcaagccgcttaataaactttgtggtgtccatgaaataattaggcttatgctgtaatgttttttccagatgcttaagggcgctgcccgtaatctcccggctttaatttgctgcaatgcgtggcaaaaattatttactgccgttcctcgtcaagtccatttcgtatacaccgccgctatagctggtaaacgtagggctgtacccgttcagcatcttaaaatagctgtcaatatatcgcagctctttcccatgaaaaagataatctaagaatttgataccgttcactctcctttctatgcggcgtttttcagcagctcgccgcactcttcccagtatttctgccgtaccgtcatgcatcaatggaccgatacaaaaccgtcaatgtgcgctcgctgctctatcttaatcggtctgaatttccttgtttccatattgtgcttaagcgctacgtttaaaaaatgtgtctttagtaaattgttatcggcaatcttaaaatttcgtcctttatgatgccctcaaattcacggataactggcgtaagattttcgccctgatatacgtcgtccatgtggaaaccgtaatttgccatatcggtaataaggtactgggcgctgtatctgtcgtagccaatcttaagcgggcgtatgccgtatacttccagtagcatagtaaaccagttgtaaacggtcgtgatagtctacgtagttctcgccgcttaaagtaatcagtccctttttaacaaatatgtcataaggcacgccgtccgtcgcctgcaagtgttcaattcttccccgtggcataaagattgagtaaacgcaatatagcttatccctctttctcaatgtaccacgcttgctgcggtcagtctgttgtctggcttaagtcaatgcgcccacggcgtaacagtccctaaagtcctctaaggtcttttcaacgcctgcgccgtctactgtcgtatattccagccatgcaatagagctattctgcttaatattgcaatacttcgtcataaactctgctttcttgcttaagctgccctctgctacggctatttcatcaacgaaaaaagctttcttttacggaaacgcccatgttagggttagcctttttcagctcgtccaaatcgttccacttttccacgtcgtcaatcatgtagaggaacggtaaaagcctacgctctttgctgttgccctttaaaaagctggtactgcgtttcatcagctcgtcataaatactgtcgttgatatatccggctgtactgatactcaaaatcatgggctgggtacgtgcgcctaaagcagattttcataacctcatactgcttaagtccagcgtccccactccatgccgccatttcatcacataccaccagctgcgggttaaaaccgtctgatttcttgcattgaaagcaatcggttttacgaacgtgttgctttcctcaatgtaaatatcactgcggcgtttcttcgccagctcttcaagctccggctctgccagtaccattttataaaacccgtcatacacaagcgccgcttggtctaactttggcgctaaacaataaatttcctgcccgtattccggctctaaaaatgccatgtatgcaattatcgcagacgcaaataaactcttgccgttttttctgccgataactataaatatttctcggaaaattcgtattttttcctcgtcttgcactccaaaaataacagaaactatagccttttgccatagttccagtttcaataaatcattgcgccccttgctgtggtggcaaaaaattctcaataaatttaatagccttatttgcagctttcgcattaaaaaaatactcctgcttttccagtgcgtccacaatgattttatatatctgttttatccatttccccgctattatttcgccgcttgtaatctttgcgtggtactcatagatataatttttatacggtatcactccgggttattcttcccgcagtgccgccagtttgcttgctttccgctttgctgctggcactaattccgtcagctgcttaatgattgctgcatagttcttgcttaaggctatgtaagtttctgcctctgggcttttctttgttccccactggttctgcccgttctggtattcgcttgtccagccgtctttttctatcattgcctgcaagtcgtccagctcgacactcataaaagcagccttttctatcagcggcgttactaacttctttttgttttcgtctaagtctttgaaaattcctttaagtctggtcttttctgcttttatcctctgttcttttgtcttttctttccttgttgccattcttttaccccgctttcagttcctctgccccataccacaccccctacaccacgcctgcgcacgcccgtagggtaattttagggtatccccctcggtatctgtcccctttaatttcttttctgcataggggggattataccgccgtctgcatcaaatctataacgcagcctcggtgcgctcttatgatgctccttgttgtggcagtcttggcataacgcctctaagttatcccagttaagcgttatgtctgtgtcattgatattgtcacggttaagccagcgcttgtgatgcactatcttcgcaggctctccgcatctctcacaaataaagtcttgtgacattaagtaagcagctctggtattctcccacgctgccgataaataaaaactcttagcccattctttcacgctgtcccctctctttcttttagtatcccagcgccctaagtttcatgcgctgggtggaggctaaagaatgaaaacaaaaaagagtaggttactgctgccacctctgcggttaagctctcgcctactcttttcatgttaccattatatctcttttgtttttccatgtaaatttcatgtttttttcattcttttgtcacgctgcctattcctgctatcttatcttgtcctcgtccattccccacaacaataccgacagctcatttataatagctgttatccagcgtcttggcgtgctgtttcccgtgtccagttcctctgcaatctttgcataatccatgccctgcataaagtacatttcaaacgccttatactctatctctctgtctgctgcctttctcctgcgttctatctcttctgccgccttatcaatgtgtgccgtcataatcagagttttaaaacggctgcgtctgatactctctaagtatgtacgctgctgttcgtctgtcattcctgcaagttccagctgctccccgtcgcttattgcgttctcaatgtgaaaagctgcgtcccggtaacatttcatcagcataaaggtattatgatacttattctgctttctgtctttctcttcctgccttttgtactctgctactgctgcccgtgctgctttctgtatcagcccctctaattctgccgctgtaaatgttacccggttatctgctgcgcctgccatttcctgcgttgtcattgctgcgcccttattttctgcctctaaattctgcatttctctttttctccctttctccgctcatatctccttttcctctttcgttaatctctttgagctgttgccatatgcttaccagcagcaatgcaataattgcaagtaaaatattactcattatttgcctctcctttcctgcatggtggaaacgggcagtttttgcaatctgggtttttgcatctctccggcgctccgtttttccagtaataactacgcctttctttttcactccaaaatacttgccttgtttctattcctgctctttgtaatttcttctgtatttccctaagctcgtccctataaaatctggctcttacgttctctggtggtcttgtatagtccagcggttctgcctttatgtctaacagttcccttaaaatctctgctgtagtcgctccatactgtctaaatgcgcccgtaactataaaagccttttgccagataaaaagtttaaaacctaatgccgcctcaactttttttaaaaattcctcttctgggtaaatcggtctgtaaagccaattttctaaatctttatccattttctaccgcccctttttcgtatgctgtaataactgctgcccgcaaactgtcggctgcgtcctgccttttttgtatccgttccggctggttaagtctaacgtgttctaaattgtcttgctgcataatttctactatcttttctgccgctctcctactgtttgtaatcagtttaagtacgctgctaccgttcaatgcgttattttcatatactccataatcgcatactactggctttacttcccagctaagaacatttcccttaatctctaatggctgcatataatccgctgcgttccggcacactgtccctgctgcgtccattccattccccaacgcacgcataaagtttgccattactcccgttaatgtttctgcggctctccctatgctttccatgaaatcaactttagcaagggcttttgttgcccttgctaccgcctttctccgttttctcttgtctatacttgctggcgggtttaccccatgccgctttttataattctttttccactgtctatagttcatgctctgccctcgctttctgtttcgtaatcgtcaatgctcatttgtcccggaagttgcccccctcggtgtccgtttcggacacttctttaaaccagcctttttctaccgctatctccttttcgcaaattcccagaacacagtagccccctgcaatagctgtatgcgtttcctctgtatccatgcaggatatatatacctctttcgtgtttccagtggctctgccctcttcaaattcttgtataactgcaatctctccgatgctgtacttttcatacttcaaaagcaaatacggcaacagccctgcacatacggctttaaatgtctgcccggaaactctgatatacttcttttcttttgcgtcgcttggcagatgctccattttttctgcgtccgctttctcccgtaattttttctttgtttcccggtctattctgtcctgctcttcgttgtacctctgctcgtctgtcttttctgcctctgccttgtttatgtactggtcgcacttctcgcaagtcccagtctttacgttgcaatctttatatcgctggcaggaataacacaatgatgtaatgctttctgggtgtggtgtttcgtaatcgtcccccgctttctttcctgccacctttgcggctatctcctttgcccttacgctgccgcctgctgcctgctccgcaatttccctctgctcgtcctctggcagttttgccgcctcataagcagccgtaatacccatgttcccatttttcagctgctctttaatctccggcgtggcattgttgttaatgctctccattctggctacgtttgtgctgctctcattcaacatagccgccactaagtcccgcatcttgcctttaatctctaatccgtcctcttcttttgcccggataagcgccgcttttgtccgctctactaatctagtcttttcgtatgcagtaagcccctgcgtatatccattacccgccagtaaggacagctcatacattgcctctgtcatatccttgtagcggtactttactttctcatactccttatgcccccgctccaaattcataatatttgctgcgtttcttctatgcccgtctactatccgaaactcgccgtttacccttgcaagtaccgtgggctgctcctgccctacgtgtaaaaaactgtctgccagttcttctatgttctctaagctctggtgcgtgttctccggcgcagccttaacctcataagggcttaaataaatctcttcgtaatcttccaccctgcctgctgccgcagctctgctctttgcgttcaaaatatcatttaagccaaattttgcctttgccatgttctttccctcactttttttctttatgcgtatctaaaataaatcaaatagattttctgttcataggtcaaatcgtcgctatacagcatacggttaaaatcactttctgttaaagcccgtacctttctttttaatctatacagaaaaagccatatacttaaaaacatttcaaaaaccgtcataatttatctcgctttccccgtgtactctgtaataaatttcttgtatccctgcgccgctccgcagcacgggctatattcataaatcggctttcgcataaatgaactttctgctactttcttggaatatctgataacgcccagtattttatactttccattctgcgccagccattccacgcccgccgcctctccgtctgtattctggtaggacgttaccagcacgccgcccagatgtagccgttcattaaacgcttttgcgtcctctatctgttctgccacaatgtccagcccctctaatgcgtcctcgtcaatcttcacgggtactataacctcgtccgtgattgccagcgcatttaccacgttaagccctatgtccggcgggttatctattatgcagtaatcgtaagccctctgcacttcaatataatcaaatttcgcccagccataccccagcagctttgctgtcgccagttttttatatctctctatctggttttcattctcttccctcgtcaaattccatgcagctccgaaaagtgacagattagcggctataatgtctattccctcatactccgtatgttgtataatttcccctgctctctgccattccccactaagcatccttgttatcggcgctatactctctgcgtcatatcttccatacgccctgcttgcatttccctgcttgtcgttatcaatcagcagcaccttaaagcctctgcggtacagctcgtatgccatatttaccgccgtaaaggtctttgctacgccgccctttaaattcaaaatacttattgttttcattctttccctcacttcctgcgcctgcctcttagcgcaatgtaatagttgcctgctcctttgtcagttcctctgtatgtaataaataccgttctatcagctctgccgctttctgccagccataacataccgctgtataatagccctgctgccgcagatactctaaccaacgcctttgattttctgttgtggtattctttccagccttaagctcaatgtaaagcccgtgataccctgcccgtgcagctggtaaaacaatgtccggcacgcccgcctttactccctgcctcttaagcgctaccgctgtcgctctgtcacgcttgcctccgtttggtacgtggtgcatatattccagttccggcatacgccccatgttatacccagcccagctaaacagtgcctcttgattcccgctttcgtcgtcaagtctaaaatttttcatgctttcgcctctcttccctatgctgcctatataacattttccattcgtctttattaagctgtcttttgtaacacaaatagcgtgctgtctgtctttcaaatatttccagctgctctgctgcatctgtcccttttccacctgctgccacaatcatgcatagcgacgggcttataattcctaatgccctatttatttccccgctgcatatacattttggtgttttcggtctacgctttatcataaactctttgtaaaatggcttcttattctttctcatattttcgcctcgccctcttcttaaactccacatacttgtaaattcgatacagcagccccgtgtttccgttctttcttgccgcctctactgccagcagctctactgtctgttcctgctctgctgtctttcccgtcattacgtcccaacggcaaatatcaaaatattcacaccgtatgcagcagctgtggcagcctttccctttctggaataaccagtatttaagcctctctatcattttccgctttctcctttctgctcccgttgtctgtccactcgtcctgccgccgcatcacgtctgccgctatcccaaacgcaagcagccctaatgccacaaacagcaataaaactatcgcaatcaacgccgctgcaatcagcagtccttgtattatctgcatcttatccccccttttcctctaatttgactaacgtatatctgaaatacccatacccgtaataatccgggctgtgtacgcctttgcttacgctgtccttatccacgtaatatccttttatctctctcggctctgccttaaaccactgcctatctgtaattacccttatttccggctctggtcttacaaggttcttgctacaattccaacgcttgccctgcaatgccccgtcctcgtcttttctgtgcttgtccgtatatttgataaaatagcttgccagtttcgcataattgccactgtcgtccagaggaaaaacctttatacggttatgcccctcgtatgccttataccagcagcgctgtaaaatctctgtgtcaatcttatttatcactaaatgatgatgccttgcacctctctcccctatctccataacgtgtatgtacttaagctctaaccctgcctttttgtactctttccggcactcccttaaaaatacgtctatgtccttacgcatctgctcttttgttctatctggctgccctttctttcggatatagtcaagttctaagtgataatccccataaccaaaattagcgttcatcagtattcttaactttctctccgcttgtctggtgtttacctttgcctgctgctcctttgtcggcttaaccttatcccctctctttatccccggctttttatatctgcttgtaaaatacctttctacctctatcgttttccctgctctggttatcctctctacgtatggcatacccttacccctttttctctatatctgtcggatagttaatacttttatcaagtggtaaaacgggcttgctgcccgtgatttttccttgcttttctgccatacttcgcttataatatttgtaggtttaaaagctgtatagcttagcccctatggtattcccgtaccgtaggggcttttcctttttattcaatttttaccaccatgcagcctgcggctaattcgctcattgcgtaatcgtaggctctctggtacggctctttgcaactgtacccagtgcaagtatgtaagcggctgcctttgcaaaatttgcagctgttcatttttgcgtaatcatttgccgcctgctcccgcagtttgtctatctgttttcgtacctcttccagcctctctgcgtttactacgggaatacctagcttgtctgccgtttctatctccctgcgcataccctcgctgataccatacttgccgcctacaatcacaaaatcgcagcttttcagcaacgctaggcctgctgccagcccttgcgcccgttcctgcggttttctctcgtccaaacactgcgtcatatataaatgtggtgtaatcggtgctaaacccgccttaatcgcctgccttgtaagtgcctgcgcatattctatatttctgtccagctctgcgccgtcctttgcccggtacggactgcatatgtacactttcatcatacctttttacctgctttctgctgcgcctctgccctcgcctgctcatttcctgccagatatgcagctaagcacataagctcgtccgctcccttttcgtccataaaatcgcaatcaatgcagcatttacagtatcccgtaatctgtaaatatctgtcgtacacttcctgcggtgtctggcactgctttaagctgcttaccatgcctgcaagccgctgtactgcctttatgcctacctctccacctttcccatgtatccctactgtaatttcccgcatttttgttgtgccgtctgctcctaatactgttttactcttcattctgtgcctcgctttctcctttaagtccagctaaaagcattgtcattgcgtctatagctgtgtcaaaatgtttccccagctctgctgcaccaaaaagcccctgctgtctgtttcttccgttccctttcattacctgcgcttgcagaataggctttaactggctaagtcccgctatgctatcctctaactcttcctcactcacgcagatttttacataaccttttccgatatgctcaacgctcatttttactctgcctttccgattgtgtgtactgatacctcataggctgtacgtgtttctgttactctttccgttactacgccgtctgcgtaaatttcctctatcaacttttcatattccctactctgcaatctccccaacaactttactgtgtcccccggcagccagtttgccacctcgtccgctgtttcattccagcaaatacatggtataaggctgctgctcttcgtaagctggtttcttacttttacgaaaatatcagaaatgcgctttcttctcggcgtttctctgtatgtaggtttatatacaatctcgcccactaacactatgtcattttgcctttctgcctttgggcttaatgccacaaaatcagccagtacaaaaacctgctgccgccccgtggaaaaatctttaagtgtctgcatcttcccgtaaagtaaaagcctgctgcctgccggatactcccgcaaaacgtcaaactttacgccgttcgtcgatttatacggcgtgtcccacgcaaacgctactaccagcgtgtccgttatcccgctcggtctttctacctcaatcagccccagataccccttaaaccgcagcccgcatatatcctctactactttcagctcctttacgtcccctgccagtcctactacgttcttttcactgctgcccgctgtcagctgctctaaaatttccgtgttaaggtcttttaaaaagttcggcataatttcttttttatcctgccctttgctcatgtcttgcgccctctctttctcttccatagctttgtagttcctctgtcgctcttttgtaacactctacgtctttttcttcttttaccttgcatacacattttccccgtttctccccggtatactcccagatttctataaaaccgtcgtcatatatgctaaatctgctgtgcatacgcaagttgtgctttttctgtaatggtctgtatactcggtaaaactcttttactgcctcgctgtattcgtccatgcgcagcccttacctctccggcatctgatataccctcggtatatccgttgccataggcggcgtaggcgtgctgcctctgataagccccatgctgcccgctgcatataaatagctgctgcatactttctctatctcgtccagtacctctatacagcgctctttactctcatactctgcaatttcttccgtacacccgtttcctattcttattgtgtggcgctcttctgctccttttttcatatattccacatactctaatgttgcatagttgccgcccagctgatacagcttttctctgttctggctgcgtatatatacgttactcatgttctgcctttctttccccggtttcgtccggctctttgtgttcttcgtatccctctaagtatccggcacaaactatatcaatctctttgccgtccctgccgtcgttccttatctcgatttttccgtaatatgcgtaaatacagcagccgtcataatcaaatacccgtatgctgccctctgtcgcctgctccggcacttcaactaccagaggctctgcctgctgctttttatcagtgttcttatgttcctgctgtggctctcggctggtaagcattgcaaataatgcaataactattactcctgctgtcgccgcagctatccatatcagtagtttaagcgccttgttttctcgtctatgtttcttcctcatgttctccctttctgtcctctatcatttctgcccgtgtccgttttttaattccctctgccatttgcagcgttctaatttcgtcctcactaaattcccataactctttattactctgtggcgcatcttctggaaaaattttctgcgcttgtataaaagcgttcataaatgtgcctaactcctcgtaaaatacgtttctgtaaaattcaaattccagctctatttctatccgctgtacttttgtgcagtaaattcctattttctgtcgttttcctctggttctgtaatattctgtattatccgaatagcccagtaccttatacatacactgtttaagtagctttatttcatgccgcccgttatagctgaaaagaaaatactctatctcttccttttccagttcttccagcgtacttatgccgttcttttcaagtaggcgctgtagcatttttgccgctgtttccttttctccccctacgccccgctctgccagtgcttgcaatttcttaatgcgctgtatcgtcttttcgtccattagtttccctctctttcgtttcccagtaatagctattcactatgcacatttcccggctaaaaatcatatacagcgctaacggcactgtaaaaatcgctattgtagcgtccccctctaatatgtaaactgccaacgccgtaaatgccagtaacgctacaccgttccttttctgtatgataaaatactggaggcggcgtttcttctccctctgccttttccgcatatcttccagcgcatctgcgtaccctcttctatacgctgctgttactgctactcgtttttctcgttttagttctgctatctgtatgggggctatattctccattccctgcctctctttcttttggcggcgctctcgtaattttcattgctaccgctccctattctggcgtaatttaccgtgtgggcgcttttcacattaaaaagctgcttaaaacctgttgaacgactgcatactttatagctggtatacccgctgctattttttcacggtatccagatgcagctattcgcctgctgccctctggtgcagctcgccaaactgctacctaaaacgccctgctggaattgaaccagcgcccccgctatatccggctgcggtattctcccactgaattaagggcgcttacttgcggctgctgccgcctaatatggtatctctaaaccgttttcatttaaaaaatctaatactttcatatagcccaaccctttgtttgtcggtatccacataccctctttgtcatattccccgccacctaatacataatctgcaagccgcttatcttccttttccagctttaaaattctgtccctatcttgcagtattccaaataagcaaaatatacagcccgtcctcttacaacccgtcgtacaaaattggcagcctttataatcattcgtagcctcgtatattgttatctgtcctcgtatctgctctttgtctaattttggtactatctctccgtagcactctgcgtaatcaacctcatacttaagcaaatattctaaaacatcattttcgctccaaaacgacataggggcagacattggacgctttaaatcaaaagcattacagccatgctttaaccacttttgcagtcttaaattactttcttctgccattgttgctacgattggcagcctacccgtttctttctcatactttttagctggtttctttttcatgtagtcgcagcatttatgcgatattctaaatggtgcatcaagcaaaaatttatactgcggtatgttgtacttacttttctccccgtttttatctaccgctacgccgtccagctttttcattctgtatgtatagccttttccgctcttaagccctaccctcgcctctgcgattgtttgcgctacttctttggaaattactgggtatccgtactctgtaataatctgcttaaagttcttttctggtcttactgttacgtctgcgtgcctcttcccgcaggctcttacgctcctatgctctaaacccgtatcaacaaactctctcggcagccctgcgcctatgaaacggctttctatatcgtctaaaactctgctgtctttcccgccgcttatgcttatgtatgcgtcgtgatattctataaaatctgttatacgtcttactgtcattctgatttttgcatctaacggcaagctctgcatttgaaataaatctaattttgtatgtactgccattctttgcccctcttctgtttaaatcgccctctgtgccatatctgcgctgtactgctgcctattaccaccaccagcaccgcccctttgcagctcgtggtaaatcgtggctctatgcacgtccatagccgctgctatctcgtccgctttctttccgttccggcacatttcttctatggtctttctgtcctcatagctcaatctcttgtacttgcgtgccatttctcccgctcctttctgatttttggataaaaaaatagtgcgatagagttttttaagctctaccgcactatgctttttacttcaatctaccgtaaaaaaataaatgcggcagaggctttaatacctcttgtcgcatttaattttaaaacttatctaattttcatttgacttaaaaaaatttattgctttttttttgaagataccttataatgcaaatagtagaaggtattcattatgtatatttctactatataaccccttattaatttatttatactcccctcaaaaaggccagatttccctatctggcctttttactgtctaaaaataatattttttattgtaatccgatcgccttttggattctttccttcacctgttctgcaatttccgtagtcttcatatgtttgtaatcatcataatacaggggctttaaaaagtgcacctggactgtgacaggctttatcgtattggaatcaaaaggaagaaaggcatcaacgagggccaccgggacgatcggacatttcgcctttacggcagccttaaagcttcctcctttcaatgtctgtacctcatttccgtttttcgagcgggttccttctgcaaatatgagataattcctaccccgctttacttcctctgcaacacttaaaatcacctgcatggactggcggatatcatcgcggtctatcatataggccttcatacatgcaaaaacctgttttaaaaactggatatcagccacttctttttttgcgaccacagaaaacggccttggacacgcctctgccaccgccagtacatcataaagtccctgatggttggggtagaaaataaatccgtctttctctggtatattttcttccccatggacttcaatcgtaacatttcctcctttgtttgcacgggatgtgataaatttcagcatagcaaaccgcttctcctccggatatttatccacatgagaagcataatagcacagcttgatccacataaacggcaccagaaaaatgtttctgaataccataagcaaaattctcttcattttttatcactcatttcatccttctgcagtaactgcgtgtttgatctccgttttttttgctcttttctcatagtatccgagggataaaagagaaaaagcaatcagaattcctataaatacaagcacatccgccgtgatgccgccgccgatcatgagcgtattccggaatgcgttcacactgtaagtaaacggcataaacggatgtatcatctggtagaatttcggtgacagttcgatcggataggttcctgccgctccgcccagctgcagcaccatgaacaccagcacgataaagctgcccactttatccagccaaagattgaaaaacgtgatcatggccataaatgtcatagagactaaaactgccatcaaaaatgttgccgtcagttcttttggcttcagaccattgatgagcatcagcataagaaccataacaactgcctgcacagccgcgatcaccgccatgacagaagccttggacagccaccacctgaatccgcttcgcaccctgccgttgtgttccttcagcggaaacatgaggcagaatgcgatgcatgccacatataaagccacagacatcatataaggagccatggcatggccgttattctgcacatctgacatctgagaatgttctgtttttaccggtgacgcaaacatacccacggtcttttttgaatcttttacttttcctgcctgtgcagctccgtcagaaagttttgactttaatgtgcggcttccgtcctgaagtacagaaagcccggtccccactatttcagagccgtctgccagtttttctgccccgctgccgatctgttctgccccgtcggaaagtctgccgcttccgtctaaaagagtccggctgtttttgttaagctgaccggttcctttgcagagactcagtgtcccgtttttcagatctgccattccatgaaacagctcaggcagcttttctgtcatctttccaacacctgcgttcagctctgacgctccagtcttcagctgtcctgatttgctgtccagctgctgtaagcccccgtttacctgggttactccggctgtatatgcattcactccttctttgagtccgttttttccatccacactggttttcagcttttcggttcccaggtgaactgtctgcatgccctgaatcagtcccatatccgaaggttttgtacccgttttatcaaggtttgttttgacctgactaagaccggaggacaagctgccaatggcatccgcaccgtttctgagaaggtatgcagtattcttcatctgatctgccccagctgactgtgtactggccgcagaatttttgaccttctgtgccctattctgaatcgtctccgcatcagaagaaacagcatccgcacttttctccagcccggagagtagactctgctgttcctccctgctgagtttctgaaactctgaagaagcctttaaatctgcaatctgctgttttagctcatctgcgtgttctgagaggtccgaagccttctgcgacaatgtctccgccgttttttctgtctgtaagcttacggtctttgatgtcccctgagggtccagctgatcggctgcctgtttcatccccgcggccagctgctttgtctgctgctgtttttcgggtgtcagcgactttccaagttcagaggacatggcctctaatccggtgaggacacttccgcttcctgactccagtgcctgaattcctccggatagcgcctgtactcctccatttaatgaactgctttttttctcaagctcactgctgcctgcatagacagccccgactcctttcgtatagtctgccactcctttgttcagtgttccggttccgctttttaactcatcagcgccggacttgagagtttttgcgccttttgacagctgccccgctccctgatccagcttctttgctccccggtccgcctcagccacgccgtctgtgtagcgtttaagccctatctggagagaatctgctccgtctttaaatgtcagagagctggaggccagtgtgtttaaattgtctgtaatggtttgactgcctgccgaaagtttctttgctccgctgcctatctgctctgcgccttcggcggcctgcccaaatcctgctcctgcagactttatctgccggaacatggtttttgtataagtcttcgtgacctgttctgccacctgggagcggatcgtatttacggccgtctcatccatcttggacgcaatgtagtttgttcccgggttcgtccggtattcaagttccatcttcttcggatgttcatttaatactgtagcagcattttctgaaaagttctcgggaatcgttatgaccatatagtatgttccgcttctcagctttgagtccgcttccgcctcattgacaaaacgaaaatccatcgcatccgatttcttcagattgctgaccagctcttttcccacttccatttttgttccgttataagaaaccgctttatcgttgttgaccactgccaccggcagatgttccgtctcaccgtacgggtcccacatagacccgagaaaaatcgtcgtgtacagggttgggatcagaatgatcgccgtcaaaaccagcatcatccatttactgttccgtatgttctgccattcttttttcagcatctttcttccttctttctcagcttcatttttatgtccttcccacaccttttgtttacaaaagaatactttgtagatataatatatccatggatatttcttatctacggatacagagtattatattcatccggtttttatttgtcaacacatcttgataaaacgtctccatatcaagtaaaattgtgtttaacaaggaggatttataaaaatgaaaatcaaaggaagcctggagcaggccgtctgtattctgctggtcatcgcccataccaaaggccatgcccctgtgaaaagctatactctcagcgaacgtctggggttgtcagactcatacttaaagaaaatcatgcgccagctggtcgtggcgggcctggtcgattccgaagcgggaaaaaagggaggatttgttttaaaaagggccccgaaaaacatcagtctcctggatgtgttcgaggccattgagagtaccgctccatttctgtccactacaaatctggtagataaagtattcccgaaggaaaaaatgattgctcatgaaaaagaacagcagatcatctctgtttttacccgtgcagaacaggcttacagacaaagtctctcacaatttacactggatcatgtagtcgcagaggatctgcctgacagctgatcctctcccgctctttattatttctttttccattttgcataaagtgtataatttgcacgctttcctttcggtatggtcttgattcttttcttatatttcttagatgtgtaccagcctttaaaccgataccctttccgagagggatttttcaacggcacttttatattgtagtaactgatcatattcgcattgttgtttttgcctttattgagccggtatttgacagtatatccttttgttttgctgctgtatgttccatacactttcctgcccgcagaatcccaacggtaagctctgattctgacataatacactgtatttttcttaagccctgtcagtgtctttcccccggctgcagtttcccatcgcttcgtggaacttttgctgaaacctgtattcggtgacacagaaatctcatagcccgcggcaccgggaaccttagaataatccactgtcatcgtcggtcccaacggattcttcatagaggtcagcttcggtgcctaaagagcgatcttctgccatttggcatacagtctgcactcccttttctgtgtaacagattctactctcgatcgaaaccctgcgtctgcataccagcctgcaaataaatatccatcccttgccggagctttcagacgcaccggcgtattcgaaaactcagaaggattatctctgtggtttcggccgccgtttaagacatattcaatagaataagatctgacagatactataatgttacagctggcctttatgccgcttccgtcattggctttggcagtcaccactgcccggccctgagataatgcagtaacctttcccgcgctgtttactgaggcaacctttggatctgagctgctccattttaccgtcttatccgctgcatcctgaggctgtacctctgcccctaaagtaaatttttctcctgtatacagtgtcttctctgtctgactcagcacaatcctttccaccggttttggctttactgtaacctgacaggatgaagcggcttcgcttccgtcgtcggcttttgctgtgatacttgccgtacccggtgatactgccgttacatttccattatcgtctacatctgccacagaaatatcggaggaagtccactgatatccgcagtctgcatcgaatggcagagcccgggccttcagctgaaaagtttctccaacaatcagttctttcgcatttggactcaaaattatgcttgaagcctttacatgataggacagcaggtcactgtatgatatatcactgtctgaatactcgccagtgtcagaaaccgcctggacagcagccttgtacccgccttttccatatctgctcaaatctttggaacaatccaggctctctgtactgctctcttcgtctgtaagaatctcttcgtctgtaagaatctcttcgtctcctttgaaaactgtgaccagatacctggatgccccgggaactttttcccacgtaagttcaccgaatcctttttcatcccaagtaatctttctgggcgcatccagctgcggggcttccttcaatgttccgatatatttttcgccgcttttttgtacaggcagcacataccccttggtattttttagcctgaccctggaaatctcagtatttccaacaaaagaatctgccgtcacataaataccctcggatatcattccctgttttggaagaactgtgattgaaacctgaggatcaaaatctttaacagtaatctggcttccgctggtgatctgaagatttgcctcctgtccgtctgtctccagtgatcctgccttaatatctccatctacggtgaaagattgtgttcctcctaatatggtcagccagccgctgctctcaatgcctcctcctacaaatacagcatcattgttccactcttccggtgccgcattaatatagccccagccgctgattttcccctggatagatccgttatgcaggataaggaatgcctcctcattttctccgtttatattcccgtaagtgccgctgaatatatctacctgctgtcccgcatctccagattttatatatctgatatcaggcggagtcccctccatcgtaagattatcttcaaatacagccatatctgtgtcgatcacaatgccgtcctgtccggcgcgccccgtaaagtccatggtcaaaaagctgaattccgtgtattctctgattgtcagaggcttgctgaccgtaagcttagcgggagcagatccgataccggaaattgaaaacgtatgtcccggcagggaaagttccagcggctcatcgactgtcgtgtctcccgagataatcaaggatatgttttgtttcccggatttggcggcctccagagccttttgtacagatgcaaatgcctggtctgccgactccccggtattcccgtcgttccccgatgttccgtcaataaaatacacactctccttattttttggcgcggcaaaccatcgtttccctgatgacgtctcctctgtgcgcatctcccatgcattcacatcgtttgaaaacgacagacgtccgtctgaatcttttctctccgaaactacctgtcccctaaaccatggagtgatcgttcccgagccatttaccgtccccttgacataaagatcagagctgatgtccagattggcgtctcccttcatattcaggttcccttccagcgtggttccgccgttagtgcccatcgtcagaatagagctaagagtcacatttttaacctgaaacaggttatatgtgttaagaggcgcggcaatattcagcaggtcaatattccgtgctgcctccctgagattctgttttgtatagatatttacaacggatgccgtgtccagccggtcggtcagggcattgtccctgatcgtaacctctgttccttccaaaacttttgccccgtttttcccataaccgtatattccggcaaagtttccgccgcccacatcaatccttgccctccgccctgagacttctgtggtgtccggacttcccgcataaatataggctttctgattgtcattttcattcacaaaacactggaccgtatcggtcagggtcaacgaatatccattgacataaaaacgcctggcctcctcatcaacagaagtagtctcaagtttgatcctgtcaaacttcagatcactccccagagttatcccataacggagagtcagagatacgctcggatgttctccccggattgtaagttttttctcctcaggcgttgtaatccccttttgatccacataggaatcaataatgacaatcgttcctccgtctgctgcagcccgaaatgccgcattgatatcatgcagcggctgctcctttgtactgccgtctccagacggatatccgtctgatccagtcagaaagaccgtcttaaggcctgatgatttgacggtgcttcccgccgcagatattttcactgtctgaaacagcattgaaaataccatgactgcggcaaggaaacaagctgtgatccttctaaatcctgttaagttcaacttagtcccctcctcaatatatttgtgaatgtccccatataatcattaaataaaaaatgcattgctgtcctaaaaacgcaatgcataaaaactgcagctggctgtcataatcaataaaatcttagaccctttagctttgcgccgcaggctttcacctgttttgcccaatatgtaatattcctttcttctaatatacttcatcccagaaactgttacaatgaaaaagccgtatgaatacaacattcatatggctctttccgaaaaacatgctgcctactgtttattcactgcagcaattcctccgcatacaagaagaatggatgcgatattaaccgcagtaaagacgttttcttttaaaagcaggccggaaagcagtgttccgaacaccggaatcagcagattatagatggaaatggaactgacctgataatgggataaaagccaggtccagacgctgaatgcaacagcagaaaggacagccatgtaaagaagcaggatcagtccgcttgtttggaatgtcaaagttccgtttcccgcatatccaaaaatcaaaagcaggcttcctccaagcagaagctgatatccggcgatcagcatcacattcatcgtctgtgccagtttcttgctgtaaatggatgcgagactctgtgacagtgctgccagtacaatgaatccttctccattccaggcaaatccgccgagactccctcctttcagattgatcaggacgatgccggaaagtccgacggcacatcctatgattttcttcgccgtcagccggtcgctcttaaagaagaacggagccaaaactaccggaaagaatgctgtaaatgagttgataatcgaccccttggctcccgtggtatgcgcaagtcccacataaaagaaataatactggattgtcgtctgaagaattccaagagtcaagagatgtttaaatgccccttttttcggcagtggcctctgtcttgtctgaactcccaaaactgcaagcaccatgagtcctgccgccgcgaaacgaatgcctgcaaacagcagcttgcttccgatatcgtctccctgtatcttgaaaatctcgtagcccaattttacgctgggaaaggcacttccccataaaaaagtggcaagcaccgcgagggctgccatcaatgatttattctttattttcataaattcctccgctcctgatgattcttctattctaccatgttttacagacacattaagaatgattttcatctgtatttatttttatacaaaccgattttttattgacaaatgagtcttctggagtataatgggaaccattcaagaacaaaggcgttccgatcaagagattggaatgcctttttttcttaaaataaaaaagaggaggaattatattatgatgaagaaagttgtagttgtcatcaaacccgagaagctcacagatgtaaagcatatcctggaagctcacaaggtatccggactcatgatctccaatatcatgggctatggaaatcagaaaggatttacacagaaatacagagggaatgaattgaattccaatctgctgcctaagatcaaagtagaatctgtaatgccggaggaagttgttgaaaaggtgacaaaagatatcgtgaacaccgtccgcaccggcgaattcggagacggcaagatctttatctcacccgtggaagaagcgatcagaatccgtaccggtgaaaccggaaaagacgctttataatctaatcggcagaaatatgaaaacaataacatacttacatcattatcaaaggggataatgcagccaggccataaacggcaggcacgcattgtcccctttttgtcttaaaggaggatattaatatggacgtacagcagttattaaatattgtatggacttgcatcgcagctttccttgtcttcttcatgcaggcaggcttcgcaatggtcgagacaggttttacaagagcgaaaaactcaagcaacatcattatgaaaaacttgatggactttgtcctcggtactctttgtttctttgtcatcggatttgctctgatgttcggaggcagcaatcccatcgtcggcaccacaggcttttttgatccgacatccattgacctgcagcaatttaaagatcttacacccggtgtctttatgatcttccagactgtattctgtgccacagccgccaccatcgtttccggcgccatggcagagcgcacaaaattttcttcctatctgatttacagtgcgctgatcagtctgatcatttacccgatcaccggacactggatttggggcggcggatggctggctgagttagggtttcatgattttgcaggttccactgcagtccattctgtcggcggatggctggcactggtcggtgctgcgacagtcggtccccgtatcggaaaatacaaagccgacggaactccaagagcgatcccggctcataatattgcgctcggcgcattaggagtctttattttatggttctgctggttcggatttaactgcggttccacgactgctgccaccgatactctcggttccatcgccatgaccacgaacctggccgccgccgcatccacgttagtggcgctggttatcacctggatgcgttatggtaaacccgatgtttccatgactctgaacggttcccttgccggcctcgtaggtatcacagccggatgtgatgtcgtatccaactacggcgcaatcgccatcggtgccatctgcggagtcgttgtagtcgcagtcattgaactgcttgacaaaaaaataaaaattgatgacccggtcggagcctgtggtgtgcatctggcctgcggtgtggcaggaaccctcctgacagccttcttcgcaaccggagattccttaaagcttatggatatcacaagaggtgcattcatcaaagcacagttcatcggtgtcgctgccgttgcagcttactgtattgtcggcgggctcatcatcttccagggactgaagcataccatcggacttcgggcttccgaggaagaagaaattgcaggtatggatatatcagagcatggtatttccggttatgcagatttcccactgaaaagcgatcattaatattagtgatataaccggggtcctctcccccgcttatataaaaagctggaattcgactagtttttactaacatgacgactaatctctgacaaacttaagacatttcaatttaactctaatataatacttcaagattgttttgctgaaaaacccctgaggatgtgctcaggggttttctctcgtttcataggaaagttctgcggccttccctattaaataaaaacgctccgcgggctgtacacagatgcgtattgaggggttggggagttgaagcggcctgcccactttgttctattttatcattttgcttttttcatggttaggatcacaaatccggccatggatgcggccgtcagcagcagcattccctgcaccggccttctgtctgaagtctttgccgcgtttgtctttgatgcacttccgttcctcttactgtattcccagtccggagggttcttcttttttgttttccctccactgtcttttttactgtcttccccctgctctttctttccgtctcctgtctgtgtctgcttctccggtgtcttctcccattttgctctcagtgtcatgccatcatggactggtgttttgaagtcccattctttttctgtcccgttctcatccgtgtaaaaccatcccgcaaactcatatccgtctttcttcggctctttgggacggaccaggcggttcccgccttccaccgtctgtacctccggtgtgtagtctcctccgttgggatcaaagactacctgatgttttccggtcagcgttactttcacctgcacctttgtgccgtcctccatcgagaaggtcatcccaaacattcccgtctttcctgcctttttcgcctcattcagcgcagtcagctggtttttgtccgctttaaggtccagagtgtctccatttttgttctttccccgggccttacagagttctatgatctcttcttctgtaaacgcctctcctccggtctcatgctccgcatcgtcagccccgatggctgcagccgggttctccggatcatacgctgtcccgtcacttccctcatctgtaagatacacagtaactgccacttcggttccgccctctgtctttatggtcagcggaaactctcctttggcccctgctttctttgcctgattgatcttctccacctgactgctgtcagccaggctgatctgcccctccggaagggggtttccgtcctggtcaagccctgatgccttggtcatggccagcagctgctcttctgagaatgcagctcccccggttttactgatcacatcttttcctttcagcgtttccccgttttctgggttctccgtggtctggtcatatttgaccagggtcacgctgatcacggctttctccccgtctgcggtctcgtaggtcagcggaaagaccccggccttccctgccgtctttgcatcgttgatctttttatattgttctgcatttaaaagatagtctacgtaggagatattgttcccctccgggtccttccccttcagctccccaagcttcttgatctcctcttcttcaaacgcctctccccctgtttcctcttcaaagtcgttcgcaccgatcattgacgtcggtttctccggatcgatctgggccgcatcggtcccgtccattcgaaaggatacggtgaccgtagccttagttccatttgccgttgtgaaagtaagagggaaatccccgatctgccctttcttctttgcctcgttgatcgcttccagctgtgtttcatcggcgatgctcagctcatcggccgggaaatattcaccgttttcctgctttcccgttaccttggtcagctgttttagctgttccccggtaaacggttctccgccgctcttgctgatcaggtggttggctccgatctgttctttgctggtcttgtcaatgtcattggcatcccggaacggtccgaaatagacctttgtataaaaccttccgaccttgatatccgtcggtcctgaaaaaggcgtgccgtccatgaacgtatagtctgtcaatgaagtaccgtccttgatatacccctgatagccggtatccggagatgccttgacgtttttcaccttgctgtttcctccgccggacccgatccccggcatactggatcctgaatccccgatcgccgtgaccaccgtgtctcttccgctgatgactacattttctgtctcttgagtttgaaaagaggtaaaagcatctaaagtaccagacgcaccgatgcccggggcatactgtcctcccgttgcctttaccgttcctcccgtgatcctgatgccgtctacctttgtgcccatcccggaaccgataccggagccatactgggtccccacagcggttacgttcccgcccgagatcaggatatcttttgtatagccgcctctttcctgtgcccggcaggccgctccgatccctggacagtgtgctccggcagacgcctcgatgttgcctcctttgatcgtaaagttgacaaacccggtctcgatgggctttgtatccggattgatggccacccggtaagtacccccgatagctccggcatggcttttgctcggatctccttttgcggataaggaaccgcagctttcatcacagcggtgtccttttttgtcttcgttctcgcactgaatcgtcagggagccatccatcccgtcttttgtgatcgcatttccgttcttatacttgtcagccgtacctccggcctgactgtacagacggttttttcgtaccagtgtgatgaccacatcggcatgggagacattgatacagtcgagctttgtgatatccacggtaatgtccacgttgtccagagtgattgccgtggtcactccaggctctgccaccagatgatactttgtcgtggtcccggtgatccagtatcccttttcgttcagggcatcgtccaccgcagtgccgttcagagtggctcctttagaagtgatgatgatatctcctttgctgatatccagcctggtctgtccgttttcggccttcttaacatctaagcgggatgatttcttttttctggaaatacccccccccgatttcctgggagacttttgcttctttcaccccttgcttttctgttatttcctgatttttctcactggctgctgccgatgcagactctggctgttcctctgtctgtactcccgtctcctcctgcaaagcactctcatcagcctcagcagttactgcttcttccgttctctctgccggtgctgctgaaacgattccttgtcccacagtcagcagtgctgccagaatgacagcaaaccattgttttttccttttcatcctgtgatccctccatgataaatttttatgtactttcagacatgttgctacgtatgtcaggtaatgtgaagaaataaaaaagttagttctattatgacaaaaaaagtgcccctcccgggacactttttcaataacattatgatacagattctactcttttgctttcctctccacaagccccatcatcatcagctgatagctcaccagatatccgatcatgatccatataattcctgtgaagaaagaaatccccgccgtaaggccgatggttccgatcagttcacatggtaccctggcatagatagacatttgaaaaatcttcccgaatgccatgggctggtttctggttttcatattcagagacaccagccaggagatcagcagacagtaaaacaaatactgaaggacgattcctgcatagacaaaaagcagggagacaaagatcaggaagtagaccaatggaagcatattcgccatatcctgattcgtaaatgtgacatttttcatggtgctgaaattctttgttatggtctgtcccatgacagaagtcttgaccaccatattattctttgaaaaatgaacttcatcggaatatttatcatcgaagtcatctgccccaacggactttttatttgaatctgccgagatatgaagtgcacccaggttgaaatcaaccgcgcgttccagctttaattgtccgtctttcagttcaaaggctggcagccggttcatgacaaagtttctcgggcctcccacactcacagcaaatcctgccagatccatcaccggtccaagcagagtgatcaccagacccatcagtaatgtaaatatagctactttccattttttcacgttcagcagtttcttatactgcctcggtttggtgcaggcaatgtagaactgctccaaaatgcttattttttctgtactttgcattcttatttttcctcgtatatgatgctttccaacaatttctctttggcctctgttccaagcagaagttccgccagtttccccacaaacggaatggcagttcccataccccggctggtaatcaccctgccgtcaacgacaacggattccgtcacatattctgcttctccaagcccatcctcctgaccgggataacaggtcgctttctttccgtctaaaaatccatactttccaagcactgtcggtgcggcgcagatcgctgccagatattttccattatcatacgcctttttcaaaagcttcgcaagtccttcatgctctctcagcgcgatggtgcccggcattcctcccggaagcacgtacatggctccttccggctccagcacttcgtggaacatgcagtctgcctccacttcgatatgatgggagcctgtgatcatcttagaaggtcccacagaaaccataatcacttcaattcccgcccggcgcagcatgtctacaacggtcagcccctcgatctcttcaaatccatccgctaaaaatacaaataccttattcataagttcatcgtcctttcttaatctgttcaaaacgaaaacattcttttactactactttatgtaaaacaagcaggcatatcaggtttggtactgccatcagcccgttcattgtgtccgaaaaattccatacaagctggagcggcacggtggcccccacaaagattacaaacgagtatacaacacggtataatttaatataagaagtctttttcaccaggtattccagcgctttctctccgtaatactcccatcctatgatcgtggaaaaggcaaacatgacgatccccagaccgacgcatatctctcctgccggtccaagtgccttttcaaatgctttcatcgtcagcgccgctccggtgatcagcttgccgtgggaatccacgcttccgagcacccccgaggaagccacgatgaggcctgtaacactgcatacgaccagcgtgtcaaagaacgtccccgtcatgttgatatatccctgcctggagggatgatccgtcttagccgctgccgcaacgatcggcgcagagcccagacctgcctcgttggaaaagattcctctggcgattccccacctcatggaagaaaataatcctgagacaatcgtacctccgactccccctgccacagccctcggagaaaggcccattttgaagatcattgcgatcccctgcccgagattggccctgttcatatagatgacagcaatgcccatcacaaaataaaacaccgccatcttcggtacaaaaaatccgcacaccctgccgatgcttttgatccctccgatcaggatggacaatgccagcagagcgatcacagctccggtcagccagtggggagtcccccaaaggcctgccattgactcggcaatggaattggcctgggtcatattcccgatgccgaaagatgcaaatacagtaaataaggaaaagaaaaatgccagcacgagaccgatccatttgattttaaaaccattcttcatggcatacataggtccgccgcacatctctccgttttcattgacttcccggtacttcaccgccagaacactctccgcatatttggtggaaagcccgaagagggcactgatccacatccacagaaatgcccctggaccgcccatgaccatggcggtgctgacgccgacgatatttccggttcctatggtagctgccagagctgtcatcaatgactggaatccggagatatccccgtcttctcccccgcttttatccctgacaaacaccatctttaaggcatagggcagattcctccacggaagaaatttaaggcgtatggtcagaaaaatacctgtccccatcaagagcacaagcatgacaggtccccatacaaaatcattgatcgctttcataaactacctccctgtatctttccggcccgagcacagaaagatcctatttaactactttaatgaaaaaaaatgaaaaagtcaacgccgtgcaacttttttcattgacttttcataaatgaatcgttacaataatagatgtgtttcacgggtctgtagttaaatggatataacagccccctcctaaggggccgttgtgggttcgattcccgccaggcctattttataaaaagttccgttttaacgggactttttttgtttctcaggaaaaacttgtacataagaacatgacaagcttttcctgagaaacaaaaaacgctccgcgaggctgtacacaaatgcgtaaggaaatgatttgactgcgtcaaatcgcatttggcacacaaaactgtcaggcactctaaaaattcagaatcaaaaaattgtgacagcctgccaattttgtattttaaatttctcaggaatatgttgatagattagtttatgctgtcaggaggttatattatgatagacgccatcttaaaccggcgcagtatccggaaattcaaaaaaactgatgtttctcctactattatagaggagatcattcaggccggtattctggccccgtcttcaaaaaccaggcagccatggcggtttaccgtcgtctcaggcgctgcaaaagccgggatgctctcggttatggaacagggtattctaagagaagaagtgaatccacttctgccggacagcagcgcccatctgaacggtgcgcgctgtacccttgaaattatgagacaggctccggttacgatcttcatcaccaatgctttaggccttgacctgtcgcgctctctgacagaagaagaccgtatttctgaaatctgcaatgcccagtcgattggagccgcaatccagaatatgactcttaccgcctgtgaacttgggttgggaagcctgtggatctgtgatattttctttgcccttgaagagctgacaacatggcttcacgcggaaggccagctttttgccgcactggcagtcggatatgcggatgaatcccctgatccccggccgagaaatgacatcagctgtattaccagatggaaaaccgaatagtttgtttcgttccatgaataagcccctttactttcccgaaagaaaaagtaaaggggcttgatcaatttgcatactcatcatgaatcaataagcctgttttctctattattcaggaaaaccgcaagaatgatgaaaacccttctgccctgtgcagttataatcaattccagtgaaaggagaatgaaaaatgcatcacacaaaaatagaacagatcatatcggtcatcgactatattgaatctcatctgtccgaaaaactggacctggaaatcatctccggagcaatgcactattcaaaatatcacctgcaccggatgttcactgctgctgtgggcctgaccctgcacgattatattcagcgccggcgcctgactgaggccgctaaactgcttgtcttttcagaacagccgattcttgatatcgctctgaagtcaggatatgaaagccagcaggccttttcaaatatttttacggcaatgtataagacatctccgggaaaatacagagataatgaaaaattctatccccttcagcttaaatttgattttggaggtaactatcctatgttaaacagcaaagaagcttcgaactggaatgtgacattcgcggcagaaaatgacatcccctgctggatggaactggtacgccttgtcattgacgggtttccacacctgcatgcggatgaatatgaaacagttctgcgccaaaagatcagagcaaagcaggcattgatcttaaaagacggaaacagcgcagtgggtgccatgctcttttcgtatcaaaccggtgcgattgatttcatgggtgtacatcctctgtatagaaaaaaaggcataccaaaagcctttcttgagaaagtcatgacagaattgctgaacggaaaagaaatcagcattaccacgttcagagagggggataaggcagacacagggcaccgcagagaaatccaggacctgggatttgcagaggcggaactgctcattgaattcggctatcccacgcaaaggtttgttttgaacagggaggagcagaatcatggaaaataaagaattacagttcccggatgaatgggagcaccttaccttcatccagaccaggcttgaccaggcgcttggcgaggcgaaggaatctgtcagccggctggaccggcagtacacagatgccagacaatatatgtccgatgcccggggagagatcgatcctcatgaaatgtttcaaaatgagctgcttttaaaacagactgaccacacaggcgcatttgcagccgaaatgtatgaaaggctctgcaaattaaaggattctccctattttgcccggattgatttttgtgaaaaaggaagcttaaagccggaaacatattatatcggacgtttttctttccgccatggatatgaacttttgatccttgactggcgggcgccaatctccggtatgttctatgattacgagatcggtccggccggatttgatgcgccgtcgggcagggttgagggaagccttacaaagaaacggcagtttggcatcaaaaacgggatccttacatatgcccttgagacttctgcaaatatacaggatgacgtccttcagaaagaactgagccatacttccagcgaaaagatgaagacgatcatttctacgattcaaaaggagcaaaaccggatcatacgggatgaagaaaccgagacattgattatccagggggctgccggttcaggaaaaacttccatagcactgcaccgcatcgcctttctcctctaccgtctgaaagaccgtctcagttccaaaaacgtgaccattctttccccaaataaagtgtttggagattatatttcaaacgtcatccctgaactcggtgaggaacccatctatgaattgagtttctccgaacttgccggaatccagctggaacattacgttgattttgaatcagaaaaagatcctctggaatttaacgatgggtcctatatacagagagtccgttttaagtcatcgctggattttgtacgtctcatggatatttatatagaagaaatgccccatcagatctttgttcctgacgatgtgtcctttggccattttaaggcggaaaaagaatggatcacgaaacggtttgacgcatacagaaaacaccctgttaagcagcgtctgcaaatgacggcagacgatatctgtgaccggtttcattccgaaaataccatgcaggaagatctgccaagtgccagtcaaatattgaaaaagctgacttctatgctttctgtgaaaagtactcttgcactatacaaagatttttacagaaaagcgggagtaccggaaatgctggtgctgccagcaaaaagcactctggaatggcctgatgtatatccttttctgtacctgagcgctgcctttgaaggattaaacgtaagcaggatcacaaaacacctggtgatcgatgaaatgcaggattacactccgatacagtatgctgtcatcaatcttttatttccatgttcaaaaactattattggtgatttcgggcagtccgtacatccatatcaccttcacagcctggaagatatcaggactgtttataaagctggaaagtttacggaactgaagaaaagctaccgctctacgtatgaaatcatgacgtttgccaaatgtattcttggtactgactccttagagccggtggagcgccgcggtgaaccgcctgccttctatgcctgtgccgatgaagcggaccatcttgacagacttaaaactgctgtcagacattttatagagggacgcagttcttctcttgggatcatcacaaaaacaaatgccggggcctctgcagtttttaatctgcttacgaaagaatttgaagtccatctcctcactcccgagagtaccagttttcagaacggcatcacggtcacttccgtcaggatgtccaaaggcctggaatttgatgaagtcatcctccccgatgcagacagcagaacttacaaagccgaacatgataaaaatctgctttatattgcctgcacaagagccatgcaccggctgaccctcctatataccggagaaatctcccgcttcgcggagcgtgccctggagaacgatatatgatataatatgtctatattaaaatgagcacgtgaaaaggaggaggatttcgtggatacgtcttaccgcacaagcctggaactgaaccaaaagcagcagctgtcccagtcacagatccagtctttgaatatactggcactggataatggggagctgtctgagttcctgcaaaatgaatatattgaaaatccaatcctggattattcaccgtccccctcttcctataccgtttctgaagaccggagttttgacatcccggccgaaaacacggaggaagtcaaaacctttttgctggatcagctgaaccagaatgatttcacaccgatggaatggcagaccatgaagttcatgatcgactgcctggactccggcggtttctttaagatttctgttcatgaactttctgttcttttaaccattccggaagatgagatcaggaagtgctatgatgtgctctccgatctggaaccggccggaatcttttctgaaaacctgtcccagtgtctgctcaaacagctggaggtgaaaggtaaaaaaaccgatattttggagacgatcatcctggatcatctggatgacattgccctgggacatatcagcactatttccaggaaactaaagctcagcacggcagaagtccgaaaaaacattgccgtcatccgaaacctgaattccaagccgctccagggcttttcaacggcgaggaccgaatatatcacgccggatatcattgtcacataccaggaggaccagtgggatatccggctgaatgacgactgggtaggaaattattctctgaatgactattatgtaaaaatgctcagagacgcaaaagacccggaactgaaagactattttcaaaaaaaatatgagcggtgccgttttatcatcgcaagcattgaacagcgcagacagaccatgttaaagatcacagaagccgttcttgcacgacagcctgatttctttttaaaccatggctgtctgaagcccatgaccatgaatgacgtcgccggggatattgacatgcacgtctccacggtgagccgcggcatcaagggcaaatatcttcagtttccgtgcggcatcgtttccatgagatccctgttttccggcgctgcacctgcctccggcgcgtctgtcagcacgggagatatcaagatgatcttaaaagagctggtagcctcagaagacccgagaaagccgtacagtgatcaaaaactctgcaatcttttaaaggacaaaggaatctccatctccagaagaactgtggcaaaataccgggaacagatggggatcaaaggcacctacgacagaaaagagacctagagggcaggctgaaaatgtcccgggctgcaccggcttctcagtctctttgccgtttttaaagaatgaaaccgatgctctcccagactctccacaggcataacgcccataagggaattggtcagaaacatttcatcgtacatttctatgtcctccggccggatgaccgtctcttccgcctgaaaagaccggcatatatatgctctcatgataccgggaagcatcccgcaggaaacgggcggagtataaagcttcccgccctttacaaaaaacacattggatacggttccctctgtgatctctcctcttccgttcagaaaaacagcttcgccgaatccctgctgtgccgccttcctcttttccatcagattttctgcgtagtttagtgtcttatagtatgtgagcggcgatgtctcgtttcttcgaatcccgctgtatgctgtacggatttttgtatctggctcttttcccgcatatgggtttgggcgcacagagatcacaaaatttttctctgataccgcagtcttcagggcatcatgcccggaaagcttttctttgttccggtccagatattcccacaccattttttctgccgttttcctttcaaaaaatattccgaaatacttaacagcctcctcaagcctgtccatatgccggtcaaaaaataccggttctccgtcttccagagccattgtctcaaacgccccgattccaaaataatacccttcatccatctgcagtctcattgctcctgtctcctctctcctgccgcgatagcttccagcaccgcttttgctttctgcatcgtttcctcatgttcaaactccgggtccgattcccatgtaataccgccgcccacgcccagatggtatgttccatccttataaactgctgtgcggattacaatgttgaagtcgcagtccccgttcagtgaaaaatacccgatagagccggtatagagtccccttctgctcctctccagccggtcaatgatctccattgcccggatcttcggagccccggttaccgatccccccggaaacatggcttttatcagctggtcaacagacatctgatcttccagtttccctgtcacggtgctgaccaaatgaaatacggtcgcatactcctccggcacacaatgttccggcacccggacacttccgggcgtgcacacgcggtttaagtcattccgttccagatccacgatcatcagcagttcgcttcggtctttttccgactctgaaagctctcttttcagcagtgcatcttcctttgcgttttcaccccttcttctggttcccttaatcggtcttgtcacggcggcgccgtcttttacgctgagaaaatgttccggagaggcacagatcacctgaaattccccatagttcatataggctccaaacggagacggattataagtgcgcagataccggaacacctcataacaccttccgtttcccggaatcgaaagctgctgtgtcatgttggcaatataaatatctccttcttcaatatgagcaatcatctgttccaccgctttctcatactcttccttcctgaaatccggaaaaaactctgctctcccctcctgtttctgtaaaaaatcaggaaccgtattgttttgcagtgtctcctccatctccagaaatgctttaccggcgccggtaagttcctctcttgacgccagataaagctgtctctcttcctggtccgctatgatgagacggtcataaaaagcgaatacggcatccggaatctttaacgtgtctgcatgtctggatgggatcatctcaaattttcttccgaaatcgtaagacaaatacccaaatgccccggaaaccacaggcagtccggtgatattttcttctttatataagttcagataatgatccagaactttctcaataggatcacgggaaatgttttcgtttattttgcacactccatttttctcctccagaataagataaggtttcagggcaatgacagaatatctgccctgttcattcttcatagaagagtcaagaaatacggcatatttttcgttcctgtacggataaaaggcctcttccggctccttataaaaatccagcttttttatttttgtcttcatgctctccacctctcacacagtctcatataatttgcaagcagctccggcccgtactcggtaagtaccgcttccgggtgaaactggacgccccagaccggctctgatctgtggctgaccgccatcacctcccggtccggggagacagcgtccactctgagtgtctccggaaggcccgctttgtccgcagtcagagagtgatatctggtcacaagaaaatcctgaggaagccctgcgaacaattcctcctgtctgtgccttaccggggtcagtttcccatgcataggtcttgatcctttgataattcggccgccgaaggcatgacagataatctgatgtcctaaacatactccgagaattggaaccctgcctgtaaacctcctcaccaactccacggattttacacattcctccggactgccaggacccggagacagaatcagtccctgaagttccttctgcctgtccagccgcttcagagattcaaaatctatgcagtcgctccttaccggttttacttctgctcccaaactttgaaagtccctcaccagattataaacataggaatcatagtgatccaccatcacatacattttaacgcctcctcagaatcatttttatactcatttgtgtgctgtctgtacaaatatctttttatttcaccggggattccaataaaacagaaagactgccaaaagcagacacagccctcaggcatatgtccgcttccggcagtcttccgtcttattctctcctgaccagcaggatttcatccgggcacaccagcatattttgttttcatttctttctgaatcttaccacacatttactgaaacttcaatcatcagcggaacagacgacagatctcattttttacatgcgttttactctttcggcgatctcccggatacagtcttccgcctggggcagtgaaccgatccggtcaaaaaacccgtggtccaggccctcatataagatcacctccgtatttatcccggcctcagtgagccgctttacaaattcgtcattgcatattttaaaatagtcaaattctgcctctatcatcagagtctcaggcatttttgataagtcttctgcataaagaggcgatacatttccgtccattgtagaatatccattctgcacatacagctcttccatataacctgccagttctttaaagcggaacagccggttcataatataatccttctgcccctcatacatgtcatataaagaatagtcccagtgatacggcgtcttctctgccggagtcaggtcgagggctccataaatataaaccgccagcttaattctctctttctgatccataagacagcagttggcagccagggtgccgcctgcactctctcccataactgcaatcttatcctcatcgattttcagttcccccgcatgttccgtcatccagtctaaagttcccagcacatcatctgccgctcccggaaacggtgtctccggggccagacggtattccggcgagatcaccactgcctctgcctgttccgccagataccggcattgattcccctttgtcttcacatccccgccaaaaaatgcgcctccatggataaacagcaccgcattctttttctttccggtgtcctttcccccgtatatatggatattgatcatatgatcttttactttaataatcttcgagatctcccagatttcacttgtcgtgatatcctcaccttcccgtttcatctccgtgcgcagaagggccaggtcaagatcctccgacgggatctgatttttctgataaaacataccgaccctcggctccccttttgccatctccctctccagaactttcttctcaaatgcatggggcgttatctcttctaatttttctttcacacaaatcttcatttttctccctttctatatcaaaagaaaaaatcccaaagaagcttgttctttgggatttttgtctttaaacaacctgctccagcagacattacgtccattttcaccagttcggaggccttgcattcgaagaaatgttagtttttcttcttgaagcaaagtttcgcaggcggtgcgcaaagcgcagtgaggctgtctgagcgttagcgagttccgaacgggccgccggaggaactttgctgaaagttagaaaatcttacattcctgagacagcaagccggagaactggtgaaaatgtcatactttagccagatattctgctacattgtcatctgtgatcagcacattgatcagctggccttttaatacgcttaagatcgcatcttttttctccatgccatatgccacgccgacgcggatcggtatttttttcaggtcttccaggcttaaactgatcagtcttccttcaaagtcatcttcgatcagttctccgtccttgttgaccacatgggaaaggatttctcctgttccgcctttttcctgcatccgctcaaactcttccactggaatgagttttgcattgatgatagcggagttttgatccacggttccgattcccattaccgccacatctgccgctctcgccaggtccatgacttccttcacactggcctcgttgaggaaatgttcttttatttccgaggacgtcacatactgcggtgccagcagctgatagccgttgccgttgatgatctttgccacctcatcgatcaggtaattagagtaagccagacgaaatgatttctctgcagtaagaggaatgttggtcgtggccatcagaggcaccaccttaacatcgtccaccttgaggaatctcagcctcacgtccttcgccaggcactccaccgtcttctgcagggtcactcctcttgtcaaggcaagagtcatatggttcttcagcgttctcagtatatagtctgacgcataaaaggcaatttcttcactgaggtcttcaccatcttttacacaggcgatcactgcctcctttaaatgaaacttttcttccagaatcgtctctgtacttgtcatggccccgtcaggataattgatcttgatctgtacatacccttcttttctggcctgagccagggtccttgatatggtcgtcctcgaaacgttcagttttttccctatctccagctgtgacatcccctgtttataatgcatttctaccactttgatgatgaatctttcttctctcaatttgcccacgcctttctgttttcaatctatacccttcgggtaaacgtgcttcgcacgataaggtatttttctatttctagtatacataactccggaaggacacgtcaatcgaaagaatcagctgaattaaataataactcccaagcatcccaatactaaagagactattgtaactcccaaagtggccgcaaaatagtttcgttttacttttgaaagatatccccatacacagagtacaacgatcagcggaagcagtcccggcacaatagagtcaaaaatggactggagtgtcgtcgtgtatgcgcttgtggcaaattttattggtgtggatactgtcacataggtagaggcaagccctcccatcataaacagtcctaaaatacttgctcctgcaataatcttgttgactaagcctgacttcagcatattttctgcaaaagagtatccaaatgtgtagcatttctgtgttaagaaatatccgattccaaagcagatcacagtcagcagtacgattggcccgatgccgcccaatggatttcctttcttagcaaggggaaggaataaaccgattaaaaggtacatcagggttgaccatgagatcgtgtcaccgatacctgccagcggtcccatcagaccggttttgaggttcatgataacctctcccggaatcgcttcatagttgcgtgacttcttttcttccagtgctaaggtaagtccaagaatcggtcctccgccccagtgtgcctctgtgttaaagaatgtcatatttcttttcaatgcttcaatataacgcggtttattttcttctcccggataaaacttcttcagtgccggtaccaatgatgtacaaaaacttggcgcctgcattctctcgaagctgtggcaggtctctgcgctgaaccaccagatcacccaggatttcaggatatcttttttactcagcagtttttctgccggttcttcttcctcatcttcgtcgtcctcatcctcgtctgtctctccctggaactcgttggatttaaatgtgatgtaaaggaatgtcaggaatcctcccaccatcagcagcggaatggttccgatcttcgtatactggatcaggaaaaatcctgcgaagaaaaatggaatatattttggttttgagatcaggtttgcaataatggcaaatcctactgccggaagacaggctcccatggcagataaaccgtttgtcactgctgccggtatattatccagcactccctgaagggcaccgcttccaaaatataatgcgatggcaaccgggacaccaaagcagataattcttgcgatggcacaatatatcaccgaccatctggtcattcctgccgcattgcccttttctacgaatgtatcgcctttctgggcaaaaaatccggccattaagtaaatcagatttgtaatctgtgctcccagcagtccaaccggcactgccaaagcaactgctgctgtagtgttgagtccggaagccatagcaaccggaattgctatataagcggccagacaaggatctgacggctgatttcctcccgctgagatgactcccaggtaaatcagctgcagtgacgcaccaataatcattgcctgcggcatgtctccgagcacggctccgacaaccaccgcgttaaagatgacggtattgaacatgaaagctccggccgtataaggaacacagcattttgctatcccgcagaataagccaagcagcactgcctgtaaaattgtaatcgtcatagtttctctcctcctatgtaaataagttagtgcagatcaggaaatgttttcttcatgatttccagcgactcttttttgtctgtgggctgcatctggaagtataacttcactccggtcttttcaatatccattaaagtctgtgcctcactctctgacagaccaacctgcttataaatctgctttctgtcgttgatgatcgccatttgtccgatggtgatctcctcgaaggacaccccttttccctggagttcggcgatctgttttacatctctgaaaagtacgaacacatttttcgtcccgaactggtttttctcccatgcttccactgctttgtccacagagaaaatacttactttgatatccggcggcgctgcaaactttaacacgcttttctgcatcttatctttcgccacattgttgtctatgaccacgatgtgctgcgctttaaagacattgacccactgtgttaccacctgtccgtgaattaacctgtcatccactctcactgctaatttctttgccataagctctctccttttattttgatggttatttactcatcatcatcgttaagaaatccttccacatcgattctgaaaattccctttttgccattttccactgtgtccatgctgaattcctttcctatgagttcttccctggacatcactgcattgatcagcatcggtaaattcattcctgccgcaacttccagtgtctttcctgtctcctgaatgtatctcataacctggttgcacggcgttccgccgaacaggtcaaccatgatcaggcttccctccggaaatgcttcgatcatttctgtaaaagctcctctgtacttgtcaatatcatctcctgcttccagagaaaaggctgcgatgttttcactgtctccgaaaatcatctgtgcagtttttaccagagagactgcaaacggtccgtgacttaataaaatgatccccggcaggtctttgttcattttttcctgtctgtaaaccttcaaaattcgatcctcctgttcatacttccatataagtgtgattatgttctctatggtgttattatatccagctgtttcctctttgtcaatagaaaatgcacattttttcattttagtggttaaaatcacaaaagagctccggaaacaattccggagctcttcgtgccaacaaataatctatctttttttctaaaaatccagcatggtcttcccctcaccgcagcagctctcaaaatcacggataaagtctttcaccgcgttttctgcaatcccgttaaatgcaagtgactttaacagatcggaactgactgtcaccgcaccgatgccgcctttccccatatcaatgacctgctgtgcgtttttaaatgacgctccaaggacttcggccttatagcctgcagcttttaccatcatgtggatatccagagcagtctgtacaccgttgtatcccagattgtccagacggtttacataaggcgccagaaactctgctcccgccttggctgccagaaacgctgacatcgtgccgtaaatggccgtggctgtaacacggatattctcactgcttaaaatagaaattgcttttaatccattttccgtgacggggactttgataaaggtatcttttcccaacacagataccatatatttcgcctctctcaccatatcttccgtttccacagataatacctgtgcgtgaagcatggcatctgaaggaatcaggctgcggatttgtttcagctggtccatcggatcaggatttcctgttttgctcagaatggtaggatttgttgtcaccccatcatatgggtatttgctgtacaattcctcaatatttcttaaatctgcatcatcaattaacattaacatctgaatcttctcctatatatgataaaattttttgtttccactgttcctgtacttctttggagggcacagagaattctatgctctcaccttttcctaatctcttttcttttgcaatgcccatccggtggtagggcatgatttcccatcctttcaaattcctcagttcttttatgagtcccgcgattcctctgaaatgttcctctgtgtcgttcactcccgggattaccgggcacctcaaagtgatcactgcacccttctggtaaagaaatcttaaattttcaagaatcttcttgttttccactccggtcaattccctgtgctttacattgtctgtctctttatagtcccataaaaactcatccgcatagggaagaatccgttcataattcctctggtcagaatacccgctggtctctatggctgtggacagtcccatctccttcgatttctttaacagctcaagaacaaagtctgcctgtatcatcggctccccgcccgaaagagtaattccacctttgcttgtacggaaaaatgcctggtctatacagacttcttcgagaacttcctctgccgtcatttcttctcccaccagttccagtgcaccgtaaggacagccttttgcatatgtttcttttatggactgtgactctttggatacggtctgcagattatgacagatgccgccgcatttgccgcacttccggcatttgttttcaaaatactgcagttcagcggccggtgccagcccttcagggttgtgacaccacaggcatctgagcggacatcccttcataaaaacattgctcctgattccgtcaccgtcatgaattgaaaaatgctggataccaaaaatcagccccttcacttcctcttccatatctctatccttccccgtacatcgttcttgcaataatttcgttctgcagcactctgtcgagattcacaaaaaactcgcagtaaccgcctacgcgtacgatcaaatccctgtgcttttcaggatggacctgggcatcttttatatcgtccaaatttgttgtataaacctggatctgcggtcctctgttttctatgtaggtcttaaggaggctgatggcagcctgcctccctttttcctcatttaaaaatgcaggattcagcttataattcaaggcatatccgcccgttatatagtcatcattcagccggatgacagaatggagcagcctggtagggccctttacgtcttttccctgtcccggtcccatgctgtcactgaacggttctcctttatgcctgccgtttggtgtcgcaccgacaatttccccgtgataaatgtggaaaaagtaaccgaagagcgtcgacacatatttatccttttctgaattgtgattcagctcaaagaccgatttggagaaatgagtaaggactttgtccgcaatactgtccacttcttctaatccattgccgtaagcaggtgtcatgcggtccagcatggcgcgcagttcttcataaccttcaaagtctgcctccagcgcatccttcatctgctccagtgtcaccttctgatcatcaaagacaaattttttcactgcacacagggagtcagccgcagttccgatgccgtaggcatagacagaccagtgcacaggacactcgcttccgccctgcagcatatcttttccatgttccaggcacccatcgatcaagactgaagaaaagggatcataacaccgttctgtcatattggctttcttctgcagtgcctcctgccggtcagcttctattgctatatccatctcctgtaaatatgcgtccatgaactcatcaaatgaccggatcttaatttcccctgctccccattttctcataacttcttctatgaggaccggaaatgcgatggcctctgtaactccccagttgggctgtttcccgggaatcatgatctccacgcatcccatattgtaataatcattggcctggtcctccggatatccaagcttcttcatatttgtgatccatatctcgtcatttaacagcatcggctgcccgcatccggctttgatcgtttccagtgcctcctcataaatccagtcaggattcagacggttcacccggagtcccacatttggataaggcatcccggcgtcttttgctgtctgaagacagatccgggtcagctcattggccgcatcttttccatccggggtaatccctcccaatgtaacactctgtacagtacgcatcttcggctcattcaccttcagccacaggcatcccaccagctcttttgcctcgctgtatgtaattctgccttcctctgtgtccttcttaaaatacggatataaatactgatccagtcttccgaaagataatgcagaaccgccctggatattggcaatgatatgcagcatccaggtcagctggacggcttcataaaatgattttgcaggcttctctgaaatcttccggcagatgtctgccatcctttttaactctctgcttctctcctccgtcacgttggtattctggctgtgcagatccagttcatccgcataccgtttgataaatcggatcactgcgtcaaccgcaatacgggctgcctcataatattcagacttttccgggtctgacgaactgccaagccggctgatgatctcatctttcatttgtaaaagacctttctgcaaagccctcccgtaattgagattcaaatgatttcccacaaaccacgggagctcattgtacagctttttgtcctctgccgcatatgggatcttgaatgcgcgttccagctctcttccgatctcatacggttccagatctttacatccggcgtaccgctcttccatcaatgcaatctgcttctgcagatctttaaattcgatgctggcgtcatggtggactctggacatcagcgaccagcggctttttttgctggtgaaatcgtcctcaaagctttttgcatggccctcttcaaacacgatggatccgtcaagattcttattttctgctttttccttccgatagttctcaatcgtctgtacagacttcttttcctgttcttcctctgtcatccgttcctcatacaccgggcacatgccgagcatactcccggcaatcaattcatacggaaggacttctaattttacttcttccagtatattggcaaaagctttcgcccttctgatctgtaccggttcattctctgtcgtccttaatgaatccgcaatatatttataaagataagtggaccgcactcccatatcatttcgctgctgtatctgctgttttaaagcttttaatctttcctccatagtttctcctttctgttatgtgcacatattttcactaatttgtgcatttacactttcactgtataacaatctgcggtgattgtcaaatacgtttgctgatttttctacgcatcaaaaaaggaatgcacctaaatgcattccttttttgctcttctcaacaacagggacctaatgaatctcccgctttttctttaagaccatatacactgctgccgcggacacaatcaaaaagatcaattccatttcacccttgtcttcgtctcctgtttcagctacgccttttctaagaacccgattggatcttgtttctgaactgcctgcatgaaacttaccgctgttatcatcttttttctttttcttcttgctctttgacggatcatctgcggtattgccgctgtttttctgttctttctgatacacaacttctaccgtatgatttccgctcacattcttaaagtcaatttttccagcatttttaagatctttccgttctactccgtccacaatgaccttctggacttcatatcccttggcaggcttccatacaacctgatagcttccacctttttctacatctccgcctgctgtgatgcttccttttccttccctggatgtcttaatctctataaagtcagggtttccctgtgtactgttgtctttctttttataaataacttccataagaatggttccggtctgcgccactgaatgatatcttccctttgtcttcttttaaatcatccctggtaactccgtctatgatcactgcagaaacctcatatccttcttttagattccactgtacttctttgtttgttccggcctcaactttggaagacggggaaatcgttccctctcctcctccgatggaagtagaaatatcaaactgctttccggctgtgcttccatcatgctttacaaactctatgtaaatcgtatgatcagacgccacccccttaaactgaatgcttcctgcgtctttcagatcatctctcccgacaccatccacgactactttgccgacatagtaaccgggctccggtttgaagttcacggtgtggtcttccccactctttgcagaagaactgtcgaacacctgtcccttgtcgctctaggaagtattgatctgatgctcttttcttatgactgaaaatatacccctttttaaacagaaatttctctttttatacaaacatgtatgattatgataggtgtgtcaattataatgtcaaataatttccgctagaagtaaataaggacagatgcccgttttgttcggcatctgtccttccttatctccagcgaagaatacagtcttcaatttttcttattgtcttatcttcttctttgcctgtaacttcaaggatgatctcgtcccctttacgtatcctggcatcgagaagttctatgatgctttttccgtcataggtgcggtccttccacatgatctttacgtcacacggcatattttcacataaatttgcaagctcggccgccgtgcgaatatgaataccgctgctgttttggatctttatctttcttctcatactcatccgatctcaagcctcttaatctcgctgtcgatccttgctatctcttcctctgtaagctcccagtcaaaagcactgcagttttcatcggcttgtgccggggtattcacacctgtgagcgccgtactcacaaagcttttctgtgtactccagttaatcgaaacctgtgccaccggcttttcgtgttcctctgcgatggcatccagagtctttaacaattccatgatctttgaaaatgtcggctctttaaaaaatgggtagaatacgagccgcatatctttcggatcatactccggacactccctgatagccccggttaaaattcctgcgccgagggaaccatacgtcatggtgccgatgccctgagtctccgcccattccatcagctctctctccgtctgatttaccatagaaaacggcggctgaatcacatcgatctttgcatatttctgcgcttccatgatcagctctttcggagagttggacatcccgataaaccggatcttgcctttttctttcagcatattgaccgctgccatcgtctcttcgatcggcgtatttacatccggccagtgcataacataaaagtcaatataatccgtttgaaggcgttttaaggattcgtcaatctccctctccacggtattatatttgcagtctctcacagacgtaccggtaaaatgattaatataagacccaaacttggtcgtcaaatataccttatccctgatcccttttaacgcctgtccaacgacctcctctgagtgtccttccccgtaaatcggtgcggtatccaccatattgaccccattttccaccatccggcgcacggctgcgatggattcctttgtatccacgtctccccagctgactcccgctgaattggctcccgcaattccccatgttcccacggtcagcgctgatatatctgctcctgcatttttaaaatgtttatatctcatgatttcctcctgatcctatctctgtttcaatgcttcttgatactgtgctccaatcagatctaaaagctcccattcatccggcagcagtccacagtatttcattatggcctcccggattccatgttcctttacgtaatccgtgatctcgatgctctctggttcttcctcatcccggtagaggaatccataggcgattcctttcgccagataatacggaaggatatgatgtttcatacacagaagcgctggtcctgtaaaacggttccctcttgagagtttccctttgggccctgcggcaactctgcggatctcgtcttttaaattgcggtttttcggcgcattcataataaaatccacccattctttccgctcttcttctgtaaatccatactctctggaaaccgcttcttccgcttcataaaaggcgccggaaataaagtcatcgatccacggatcgtcatatgtatctgcaatgtaagtacatccctttgctttcccgagaaatgccgtcatacagtgcttcatattccctgtatatactttccggtaaatctgggctttggctttcaccgatttccctacctgttctgcctctggaaattctcccttaaacgcttccgcgtcaataccgatgtgtccgtccagtttggttgtgacggcaaacgggtcttcttccatcagctctttggaagacggcatagctgccatgccgaccataacctgacagattcctgtcttttctttcagataagccagcgcttcctcatcacctttcaacaattccccaagacgtttttcaaagaaatccggagccccaagggcgttgacgcagagcaggatgttaaagttccctgcattttccctgcttctgacctttatggcctgagccagattctgcgcgatgctctcaaatgccccctcatagacacagcaggcaatcagatccacctgttccatgtgcaggaccagatctttttcgtctgaacagtccaggacgtcaaatccttttacaagcacacgccgtttttcttcggcgccgactctctcgatcagataggtaccctgttttttcagctgttccatccgctctgccatgatgtcatataagtacagatgataaccggattcataaaacagccctccgatgacgccccgtccgatatttcctgctccgatgaccagcagttcttttttctgttttttcaatgtcaagacctcctatgcgatgatgcccagtgcaaataagacgactcccacaaccatggtgccgatcaggagaggcacgactttgactcctttgccgagcagccagtagattgtaccaaccaggccaagggagagaattttcggcatgatgctgtccaatgttgtttggagtaccattccgccgtttttcacatccccgatagtgattggcgtagacacgttgaccgtagccacgatcatagcgccgatggccatgagtccgaccacagagcaggcataggaaactttgtccatgattccggacttctcggatttcagcaggaattctgttcccatactgtacccgtattttaagctgtaccagcgggccagcacattcggaatgttgtacatcagcaggaataagaccggagcaaacacatttcccgcggcagccatgccgatgactaaggatgtggcaaggattctcagcgtagaaggaaataaagtatctccgatggctgacagcgggcccatgagacctgtttttaccgcattgatactcgtggcgtcgaagtctggatttttttcattttcctcctccattgccgcagaaatccccagggcaaatcccgcaatattcggagtaatattgaagtattccatatggcgtttctttgcctctatcctgtcttctttcttgtcataaatcttatcaatggccggcatcaggctgaaagtgtagccattgtgcatctgtcccggataatcgttcatggcattcagcgcaagataccggataaaaatctgttttaaatctttcttgtttaacttagaactcattttcgtcacctccataggcctctgccgtctccggcgtatttttctggttggataagatgatcagtaccatcatgactgcaaacaatgtcaccgcaatggtcggcagttttagataagccgccagcataaatcccacaaagaagtacggtgccattttcttgctgatgatcattttaagaagcagggcaaaaccaatggccgggagcaggttggccgcagaggcaagcccgttgatgaccaccttagggatggcattgacggctgcctgcaccgcagtgcttcccgcatagatggacaggaagccatacaaaaagtaaacaacaaaactagtgaaaaatgcaccaaagagataaattcttcctgcagcccttgtattgtccttctcgatcttcttcatcatgacctgtccgaatgccgcgttcatcagtttacacccgataaagataaagcctccgagcagggcgatcggcactgcaagagtagtagccacggcctttcctccggttgttataatggcaaatgccgtacagatagctcccgcagagccatagtcgggactcactgccgctccgataggaaaagacccgataaacattagttccaatacgcttccaagaatcacaccctgcaccggatctccaagaaccagtccagtcagcgtggaaatgacaatcggtcggcaaatcatgcagtacccaaaaaaatattccattttgcagaggcctaaaatcagccccacaagcagcgcttttgttaacatatccctctctcccttctaactctccaacagtttttccgtaacttttacagcggtttctgtgggtacctgctgtatttccatgcggatacccttagaaagcaggtgtttcagagtttctgtgtcgtctgcggtcacgttgattgccttactcagtgccctgcttccctccactgccggaagtactcccaggtttacatcgttgatctccggaacggcatctgtcagcctttccacgtcctttacgttgttgaccacaataaacaatttatacttgtcagtgacgcctgacttgatggccttaatggaatcctccatagatttgatgaccagcttaattccctggggtttggaaatacgcagcatagactggcgcatctcatcttttgccacctcatcatttgccaccaggatgcaatccactcccagcgccctggaccaggagatcgccacctgtccgtgtaccagacgataatcgactcttaatttcttaatcataggtaatccctcctcattcttttcttaaaatactacgctgaccctgtaagctccggggacaacagcggcctcgaaggcttcctgcacctgatccagcggatattttgcctccacaagtttagacaggtcaattttcttttcgctgatcagctccgcggcttttttaaagtcacagagatccgctgaaaatgttccgatcagctccatttttctgtaatgaatcaggttggaatccacatgcagttccggagccggatatcctgcggcaaataatagaattcttccgtgaagatgtttcaccatctcaagggcctgatcattggccgccgtgacacctaccgccaggatgaccgcatcggcgccgcgtccgtccgtccattcttttactttttccaccggatcttccttagatacatccactgcgtgaagtcccagatttcttgctactttaagttttttctccatcatttccgtgatgagcacatcgcatccttctgcctttaacgccagtgcattcagaatccccatggttccggctccgatgacgaccactttttctcccgcggacactcttaatttgcgcagtccctggcagaccgtgccaaccggttccacaaatgccgcctcggaaggatcgatggacgggtccatcttaaacagagagcggtacggcttgaccacatactcagagcagccgaagcctccgtggtaaccgtccggtgaaagtttattccttccttctcccagagtcacacactcacttgtgaggccctttttgcagaactcacatttcccgcagttgtcatagccgatgccaaccggctctcctatttcaaatccttttacctccgatcccatatcaacgatcgtcccgctgaattcatgcccgaatgccataggaaacttcagattctttctggccccggtccactgtccgtaatctgtcgtacaaatgttgcaggctccgtttttgatcagcacctcatcggctttcagttccggaatcttccgctcatgtactttcaccacccgttcctgttcgatcactgcaaatcttgtcgtctctgtttttgccatttcgcttacctctttctctatctcctgatatatggtttcaatcttttcatcgtatcctcatagactgccgccgggtcttcaaaatatctgctgtctgtatactccagcaccagcggccctctgtaatcgttttgatccagtaatttcagtgtcccttccaggtcacaagttccgtctccccatttgagatgggaaaaggcgccgtctctgtaatccataaagtgtaccaaattcagccgttttccaaatgcatcaaaccagtcctggagggattctccggcattgtggatcgtatggatgtctgcggtcacggcaaactgtccggagttgaccgcttccatcatccgttttacatcttcaagccggttgcacagcctggtgctcttcttcgataaggtctccatagtcagatatacgccgtaatcctctgaaaatctgcagagttccccgaccatttcctcactccttttccaggcttcttccctgtcttcggaaaagaactgccagccggatgtgatcagcactctgtcacagtcaagttctgacgccgcccggatcatatgctgaaaatagcgtttcgccttttttctgatctccggtctttttgcggccatgtgaaatggcttcggacaggactgctccggcgtcatgctcaccgctttcagcccatagtctccaagcatccttttgaggctttttgtttcctcatgagtatgggcatccacaaaatagtgggctccgcatgtccaaaggtcaatgctctcatagccgctttctgctgccgccctcagatagtccttaaactcataaaagcggaagatatgattcatgggagcgggctgtttcctgtcgatcagatccataggtttaccaccggttctgtgaatcaaacagcctcatgtagtgttccagcacttcctgaaatccctcggttcccgctgcgatggtctgctgcatgttcattttcttcggtgcaaactctcctgcggccttaacatcttttcttggcgcgctgctctcaagggctttcctcagtgcattctttcctgcctcgcttaaatctgtgtttaaattgactttctgtattccggtcttcactgctttggcaagattgtcatctcctgtgccggaacctccgtggagtacaagaggaatcttgatttcttttgataaagtggagagaagttcaaattccagatgaggagttcctttatacactccatgcgacgttcccacggccacagccaggcagtcaattccggtttcttccacataggactgtgcttcttccaatttggtcagtcccgcatctcttgtctcctcatattcgtcgccctgacccacatgaccaagctctgcttctacggaaacgccgaccgcatgagccacttttacgatttcctttacttctcttacgttttcctcatacagaagtgtggaacggtcgatcatgacagaactgaatccggcgtggatcgcctgtatgatatcctcaaaggcgccgccgtggtccagattcaccgccacgggtacttccggatatctggctgcataaaacctcgccaggtctgcacactcgtaaatgccgtggacagaagccacatcaaggatcaccggcgcttttagttttcctgcggccagaaaagatgcctcgatcgtctctctgttgaatacatttggggccgccaccccgtatccttctttctttgccttgccaagcatttctcccattgaaataatcattgtatgtagttctccttcccagatcatataaatgtgatgttttttgctttctgtccatttatacaacaaaaagcgtgccaacttagtgtcacgcttttgtctctggctccgcaaaccgctgattatcttatattccatttataatgtcataaatatatccgatttcagacagtgggattttgacactgtaagtgttttctatcccactaaaggcactccgtatttttgcaatctcttctgtccgttctgcctcaaatgcatcgatatcaggatagtcttcgatcgggctcctcctgatcaggcgctccgcaagacatcccacatgaatgaaaagattgatctttgtactgtttgaaagtgctttcccgtccgtgacctcatattgtttcagacagtcctcgatgtggttcatgatcttgtccgtatccaggatcgtcagggaaccgatcagctgccggacagaaaagtttctcacgagatggtcattgatctcctgtatgcgctcatgagagataaccggggacaggatcttttccatcttcctctccgcctcccctgacacaacctcctcaagaggtatgaactcgatgccggaaagctttggatttacagtccctatgactcccaggatgtcgtagccgtccaacagggcatcggccgttgactgattgttcagctggtcatagtcgtaggagaccaccgtaatatcaatgtccgaaggaatactgtcgtcgatcaggccccggatctgctctgcggtcccggtcccggtaagacagcaggtcaggatcactttctgcttgtctatcttcggatagatcatctggtattcggtctgattgtatttcttcagccttaagagaatgtcctccagacggtacttctgtttcaccatctgtccggcgttcaccgccatctgcgtggaaatgttgtttacgatggctacgggcactctgagcatatcgctgagttcctcataaatgtccatcagggagcctgtgtccaccagaaacagaaggccgctgctcagatcatgaagctcaatatattctttgatccataggacaatatcttccatctttttatctatgggcatatccaccgcctcaaatattgtttcttccaaaagccggttggccacattggcaatactgcttgccgtggcatatccgtgggctaaaatgatggctttagtcctgccgtcctgtgacttcacattcaggctcttaaaatagagcacgagagggagcaggtccgcctccgttacatttaaatccatcttcgcggaaagcagatccatcatcctcttaacgagctgcgtttcctgtctgtaatgttcctccgcaaacgaaagaaactgccccgatacttttcccccggactcatattccgcaggatgaccgttcagatagaagaaataggctgccgcagcgtggaggacattgcccccgaatcgaacattgcagctgtattccacataccggaaagcctcgtggacactgccgatcacatagcgcatgagcatagtttccgactccttactctgctgatagatgaggcggtccagcatgtcgctgaccgcatggaagcaccgtttctcaaattggtccagggcatatccctggctttggaattcttcatagatggaattgagtttttcaaacagttccctgtaatgtatagattcttccgtgtctgcacctgcagccgtctcaggcctggactccggcgtgatcagcacttcctggctcttcttaatcttcattccgtcgttctggacgatctccgaaatgatctcatccggcagatcccccagacggagtgcgatcttttccttttctttattttttgcgtaagttgtggcacagagatatttgatggtattctggagttcgcccacattccccttaaagttatgtcctgccagcgcgtccagcacatttcccgaaactgaaaatgttctccccagcaccctgctctcctgaataaaaaagcggtaaataaactgcatccgctcctggtatccccgctccatgagatcagggatttccaccacaataggcaccctgcgcagaaatgtgtccagaaaattggaagcgagatcttctgtggtagccataacgatcctgacttttgccttatgccacccttcactttctcccatccggcggaagattccctggtccaaaaaaatgaacagtttttcctgactttcattgttcaggcggtgcacttcatccaaaaacagcatccctccgtctgctgcctccaaaagtcccttggatgtaccgtatgcccctgtaaacgctccttttacatatccgaacagattgctggacaacaactccacattgttggcgtactgggcacaattcagcgtgatgaacggcgccccttccggaagtaccccatgacagacagaaaactcataaatctgccgggccatgtaactctttccggccccggtatccccgtggagaaataccggcaggcttgtattcggataaaatacggaagtcttgatctgctcgatagcctttttaagacttccccgggccccgatcatactttccagcggatcgtcagcctcccgggactttctctctgcctctgtatgttccataaaaagttcctcgagacttgcatagaccggtttctcaggcttaaaaaaccgctcttcaaacactttggcatcaaaaaacaaaacaggccttgtattgaccttaaataaagatttccccacttctttgtttagatagtgactgactgtattccgtttcaccgtaaagatccccgacatctcatccgccgtgcaggacttatccacatgatcaaaatcagcctgttttgtttgttcttttatatatgacaataacttttccttcagcatatccctctacctcatctcatttgtactgcataatttattttcattatgccagcttcctgccatttgtcaatcaaggcattccgcaagatgatttctcagattcaaatttcttttgacactagttcttggcacggaatttgctctatatacagttgtaaatcagtgttatgcccaggcaaatatactatcattcaacgaggtgaaagaaacatgaaaaaaagattattgatcgcaacccacagcacatttgctgacggaattagaaatgcaatggaactggtgaccggaaggcaggactctgtttccacgctctgtgcctatacagacgatatgtcagaagtggaaactccggtcagggagatcatagacggactgggtccggacgaagaactgatcattgccaccgatattttcggcggcagtgtcaacaatgagtttatgaaatatctgtcacagaaaaatatccacctgatcgcaggagtcaatcttccgctgctctttgaactggtctcctgtctgaatgccccagacacaaaaaaggcgttggaaacagccgtggacaattccagggagcagatctgctactgcaatctgctcttagatcaggcgtgccctgcctgtgacacattttaagttcctcacggatcaaaccgcaggaaaggaggagattttttggccccgtcttaccgctccgctttagagcttcaccagaaacagcagatgtctcagtctcagatccagtcgctgcatattctgtcactggataacggagagctttctgaatttctgcagaatgaatacatagaaaacccgattctcgaccatacaccttccggttcttctttcactgtatcagaaacacaggattttgatattccggaagaagccaccgacatggttaagacatatcttttggatcagctgaaccaaaatgattacacagaaagtgaatggcggacaatgaactttatgattgactgcctggactccggcggatttttcaggatttcttttgaagaagtctcggcccttctggcaattcctttggaagagataaaaacgtgctatgaaactttgtccggcctggagcccgtgggcattttttcccgcagccttccggagtgcctcttacggcagcttgatttcctcggaaaaagaacgccggtcatggaaaagattatacaaaatcacctggacgatatcgccctcggacacatcagcaccgtctccagaagccttcatatcagcacagcagaagtccgaaagcatatcgccgtgatccggaacctgaattccaagcctcttcagggattttccacagaaaaaatcgaatacatcaccccggacatcatcgtgacctgtcaggggaatcagtgggatatccggctcaatgacgactgggtggggaattattctctgaatgattattatgtccgtatgctcagaggcacaaaagacccccagctgaaagaatatttccagcagaaatatgagcgatgccgttttatcatcgcaagcattgaacagcgcagaaatacgatgatcaggatcaccgaatccattctctcaagacagccggagtttttaaaaaatcacggctttctgagacctatgacaatgaacgaagtggcagaggatattggaatgcatgtttccacggtgagcaggggtgtcaaaggaaaatacctgcagtttccctgcggcatcatctctatgaaatcattattttccggctcctcccctgctgctggtgcccaggtcagtgcggtagatatcaaagggatattaaaagaaatggtgtcccgggaagatccgaagaagccattcagtgatcagaaactatcgctgcttctgaaagaaaagggattttctatttcacggaggaccgtggctaaatacagggaacagatggggattaaagggacttatgaccgaaaaatagacagccgaatttaatatcccggctgtctaatcatcgtccttataatctgttcactttaaaaaatttcatgatctccggcagatatgtggcggtaaacagtgccgtcactgtaaaggccgccgctttgtgcagcttcttcggaagtgccagtccccacatgactccggcagcgcaggcacagagcttaatcattacgagatccttccagtctgcatgtctcatgaaacggtttgtatatcggattaatttcttcacagcagtcaccccatctctctgtttgatgttccgattgttctgcttttattttaccactctttgtaagcggtgtcaccgtgtctttgcatatcctgctcatcccaccgaaagattcaatttgcctttacttctgcctccatatatctgttaaagaaatctttgaccgatattggttttgaaaaataatatccctgtccgaagtcacagcccagatttttcagtatattgatctgcccttcagtttcgattccctccgcgatcggaatcatctggttcaaggtccggcacatctgaatcacataccggacgagcacctgcgacttttcattcttctccaaaccgtcaatcaggctcttgtccagcttaatctcattaaaatcaatggcagacagtatggccagatttgaatatttggttccgtaatcgtccagggaaatcttaaatcccgctccaataaattcttctgccttccggctcagctcttccagccggatcttggacgagctctctgtgatctctatacatatttgggaagggtccacgtcatacttccggcagacattcagaattctgtttgcgatatctttctccattaaagtaacccgcgagaggttaacggaaatcgtaagggagtcagaacccgtctgctcccactgtctaagaatcctgcagacttcctccagtacatataaatcaacgtggcagatgacattttccaattcatagatcggaataaatgcatccggcataatcaaactgccgtccttttgtatttttctcacaagagcctctgcccctatgatccttcctgtctcaatttcaaccttaggctgaagatgtacaacaaaccttccctgttcaatgtctcttaagagtttcttggcaactgccgatctgcggttgtattctgcgttcaaggtttttttgtagtatgactgcttttcgatgtacattaagtcttctgcatagctgacctgctctttgactccccgtcttcccgcatcccagactgctccgatggaaatattcagttcctcgttgtgctcggtttccctcctcagcgctgacaccctgctgtggaattcctccctggatatttcagggcagagcacaacatactcagccccaccggttcttacaacacggatttttctttctttttttacctctctgtacttccatttctgcggtattttcttttttctctctgtttttattttcttcttttccgccggcttcttttcttctgatgagggttcttttggcaccggatcccatttcgctgtcagtctcatattaccgttcaccggtttattaaaatcccactctgtttcttttccgttttcatcaatataataccatccgccgaaggtgtagccggccctttttggtgctcccggttcttcggccttctcacctccatttatcatctggtatttcggctgagtcttatccgcataggtcagattatcataaggaaagtctgaatcattctcctgcttgcctgtcactatggaaagcccttttaactgtttttctgtaaaagcctcaccccccccccggttttccagccatttcctgttcccatgactgtgatcagagaaactgcagccagacatctcatccattgctttttcattgttctatccgtccttttttgccctcaagtgcactctttcttgggtgattttttgactttataagaaacttctattctgaaaaaggttagaaaaaaaggcctttaaaagcctcttttactccctgttaaattcaaatattctttgatctcctgccttgtccatcaaatataatttaaagtcctctgtcttaggcggtacatagaagatctcccggctcgtgtcacaggtgagtcctgcgactttctttccggattttccgagggcataagtcttcacgtaatccacatccccgtccacatagatcgccaaacgtccgcccttcttttccacctttgcctggagtatagaagccggggtaatcttttttggttcaggcttcggtttgggcttttggggaatcttgatcccttccagattttttgtctccatctgcacctgaggagtctcgaagcctccgaaatcaactgccggaagaggatcttcatgaagcatcacaaaaccggctccgaccgcaattgctgctccgagggccgcctttttcatggccaccactccttttcccgtattgcttcccgcagtatacaaagaccccctgagaatcggatataaagcaaagaaaccaaatcccctgattttcaaagcctctctgtctgctttcggaaggctttcgatctgttttttcagatttttccgtccatggaacaaaaggtttttcaccgcgtttacattacagtccatgatctgggcgatctctttcatcttcagctgttccagagcactcaggataatcgcggctctctgcttctccggaagattctttatgcactcatggaggattcttgtcttctcatcctccaaaataaacttctgaggttccggctccttagaagacatactctggacaaaatccaccacttcgtttccaagtatgtcggtctgactgttctttttggcattcctaagacagcaccggtatgcaatctgccgctgccatgcacaaaacgccatattatctttcagagcaggaagattcctgtaaatctcgataaaaacatcctgtaaaatatcctctgcctcagtggcatttccgcagaaattcaatacaaacagtctggcctggtcgtatgtctgccgatacagatattcatatgctctctcatctccctgctttgccctcttcacatacggacaaagatttttatagaagttcccgtccctcatctctccttatcctttctccttcgttcattctcactataaaatagatttttcataaatacaaaaggaattcattgtaacagcaagttttttgtacattgcggcagtaacttttctatggtaaactctaagtaaaataatcttccgtacataatcgcggagaatggaatataacaaggaggatctcatgaaagccttatttatcatcaatccctcttcggggaaacaaaatattgaagccacactgcaggaaatcatgtcgactttgattttaaaacaaatcactccgcacattgatgttttttatacaaagaaaaaagatgatgcaaaacaccgggcggcagccttaaagcccggagaatacgactatgttgtctctgtaggcggcgacggtactttaaacgaagtgtccaacggacttgtagtcagccagagtaatatccccctggctatcatctccgcaggaactgtcaatgactttgccacttatatgaacctgcctcaaacagccagggaattctgcagcatgataaagaatttccagacgaagaaagtagatatcggaaaggtcaatgatgaatattttatcaatgtccttgccggcggcctgctcaccgatattgcttataaagttccgaaagacaagaaggcagtcctcgggaagatggcatattatctggaaggcatcaaagaacttccaaagcagttttccaaaaacatggtattaaagtataccagcagtgaattttcagagaccacggaaaccatggtctttttagtggccaattcaaaaagtgttggaggtttcccgactgccgcaccgctggcttctgtgtcagacggctatctggacgtcctgatccttaaaaagatcgagtttttaacaactccggatctgatcgtcaaatggctccagggcagccaccaaaatcacccgtccatcgagtattttcagacgaaagaaatctttatcgaacaggcatccacagacaacgagatcgccattgactacgacggtgagattttgagcgaagggctccctgtaaggatttctatcgttccggaagcgttaaatatccttgtgcagagacaggatccacagtgatctcagatataaaaaccagacagcttcataaaccggttcccaaacaccagatcaaaaatctgacggttgggataccggtttttttactatcttatattacttgacaaagtcaatcttttgaattatatttgacttagtcaaataaatggaggaaatcatgaatgacagaatcatttgctttttatgtgtcagttctccgtaagtattttacgcagtattgtacggaaaaactcgcagagatcaatgtaacttacggacagctgtttattcttatttttgtcggcaagaaagaaacatgttcgcccaaagaaatatcccttgccttaaagctggatgcgggccatctgaacagaacactttcaaaactcatagaaaacggcctgctcaagcaaaagaaaagtaccaaagacaaacgggccaatatcataagtctgactccgaaaggccgggaagcctttgaaatgagccataatttattctgggagtgggacagcgttatcttaaatcctctttcggacaatgaaaaacaaaatttaatggaactgatgaagaaaatagcattttcggaagatgggaggttctgacatggaacagttaaacaaatttatcagccttttaacgggcagatttcataactctgaacaatatgaaactatgaaaaagaatggaattgaatttccttttgctgaacacgtaaatacggtctgcaatgataaaatcaggaatctgcctccagctttcaaaggagtcttcatgcttgaagaaacttactatacatcggacggaaaaacgcacgcatcaccccacctgtttttatttaccgagagagctgacggagtgaaactgacttcttatgagactcccgatggatataaaaaagacacatttacctatgaaaatttaacccctgttgatttcaaggatctgaaaccatcagaaaaattcacaccggcactgtatacggaaaaggacaatatatgggaaggcggcagcacaagcatgttttcccctgtgctgaaattcaccttatttgaacgcttttctgaagagtatttagaagtttctgaaataatggaagtaaacggaaagaaaacttttggatatgacaatccgattatttacaaaagagctgaacattcttaaaataatgccggaaaaatctttagaaaagacttttccggcattagatattttttaataactgatcttggttgatcccagatcttcatccccataagaggcatagattttattgttctcggtgtatactttcagctcggcagagtcctgatccttggtcagcagaacagaaaagtcacttaagctgccgcccagcggaagctggtacggagagagtttgcatgccatctgagtgaccggattttcctgattttcagagaggtcgcagtttaatcccgcaaaaggcgccacggatttataattcttaaagccatagtcaaacagtttgatcgtatccctgtacaattcatatccgtttccccgcaggatcacagagatcagctccgtatccccgcgctttgcaaaagttacgagagtaccgccggctctggtcgtatatccggtctttccgccctccacgcctttgtataaaaacatcgtctgttttaccatcttgtggtggttccataattctctgccctttttctccttgttggttcctgacataaaataatgggaagaacatgcgatcttgcggaacattggattttgaagagccgctttcgtgatcagcgccatatccctggcagtgacatagtgcttatcattgtgaaggccgttgggattcataaaatgagaccccttgcagccgatctctttcgctttcttattcatcaggtctgcaaatttttcgatactgccgcttgtatgctccgctacaccattgcaggcttcatttgcggattccagcatgataccgtacagaacgtccatgagcgggatctcctcgccggccttgatgccgatgtgagtgcttccaggctcaatgctgtttacggcatgtctggagaatttgaccgtggagtacagatcatcgttattttctatcgccaccagggtcgtaagaatcttagtgatgctggccggatagcttttcttgtcaatgttttttgcatataggatctttccggtcttggcatccatcagtattccgcagactccgttgatcgacggcttatcggcgtttgtgtcttcctttgtcgcaagtcctctctctgccgccttcgccggcacggtccctgctgtcaccagtacagctgcagtgagcatcaccagtaatcgttttacaaattttttcatatgtttttcctcatgattcttatttgaaattaaatgtcataatgtatagctggcggtccgtatagtaagtcacttccatcttttttgccccgaaaccgggcactcttttcagcagatcaaaaatctttctgtcggcgatcagctgccggtgtgccttctcatattccgtccggctgcccatctgaaaactgatctgcccctgatttttctgttcacagagctggttatagatcttccccaattcaaactgcctgtagtaatgattctgtctcacataataattgttcttctttgaactgcatttgggcaccttgagtccctgatccagcgtgtgcccccgaagaagttcctcctctgtcatcccaaaaaaccctttggacatcttctgattattgcttccccaggtagggtctacataacagtcagcaccttcgatctgtaccagattccacgcatgattctgtccattggcccttccgtacaccatccggcacgggatgcccatcttctgataaatatactgaagactcttggcatatcctgtacagacggtctcttcattgaccatgccgctgatcaggttttgattatatttgctgccctcccggtaggagatcctcctggtcagatgctcataaaccgtataggccttctcatattccgtctcttttttgtctgcataggaaagatacaatgcaagatttttcttcagtttcttatcgtactgtttggtctgctcttttgtaaaaatataatggggcaggaacacgacgtttttcttcgttcccgatgtcttccatttgatatttccggtaaagtcgaaccagaacagttcaggacagtcggattccatctgttttaaaatgtcctccatccgctttgtggtaacctgttcaatctcgatctctttttttctgttgaaaatcccgtagtacatgaggctgtaaacccttttgccctcttttgagaggctctgataaccgtacttggtctcaaacaggtctttgtgggtcttttttacctctgtgacaatcttcttttgttccttctggtgaatgcggctctggatcgatgacaccatattgggcagcgtaaagaccagtaccagcagaaggacagatgcaaatgctttcaggacttttttcataggcagctcctacccgatcagccccaggcgtttcagtcccagcgccaggccatcccggtccgcaggctccgttttgtatttggcctgctcaagcagttcagggactgcatttcccatggcaaccccgtattgaacataatttaacatctcaatgtcattggcgctgtctccaaatgcgtagctgtctttccggtcgattccaaagtgatccagcaccattttaataccggtggctttattaattcctgaaggaataaactctacggagtttacctctttatgtatgatcccggtcatgactcccccggtcatctcctctacaaagtccttctgtgcgaaatccatgtggtgatatgtccatttgttgacttcctctgcctgtgataacggatagacataaggggtcgtagtctctctcagcctctctaccaccttcagatataaatcatcctgattatccgggtcatagtaacttcctttgacgccttccaaaataatcccgatcctgctgttttgtccgtaatcaatgaccttttggagattctcaccggaaaccttctgattgcacaattccctgccttcacagatcacatgggctcctgccgcagcgatcattccgtgaaagccctgttccatataggattccggcaccatgccgtaagcccttccggtacagagcactactttgcagcctttgtccatcagctcagccacggctctctgagcggactccggaataccaatcccgtcacagtacagagtgccgtcgatgtctaaaaatacaattttattcatgcttcactcctatatattctcgatctgccagtccaccggttcaatgccgtgctctttcagaaattcattggttctgctgaaatgacggcatccgaaaaaccctctggacgcagaaaaaggactcgggtgaggcgcttcaagtaccagatgcttcggattggtaagcatccattttttattctgggcattccgtccccacagaagatagacgatcggacggtcctgctcatttaatatgcggatcgcggcgtccgtaaactcttcccatccgatatccttgtgggaattggccttgtgcgcctggacggtcagtaccgtatttaacagcagaactccctgttcggcccatttggtcagatatccgttgtttggtatgtagcagcccagatcctcgtgcagttcctggtaaatgttgaccagggacggcggcgtctgtactcccggctttacggaaaaagaaagcccgtgggcctgtcctacattgtggtatgggtcctggcctaagatgaccacctttaccctgctcaaaggcgtcaggtggaacgcgttaaaaatatcatccgccggcggaaagatgttcttctgtgcgtactcagccgtcactgtctgatacagctttttataatacggctttttgtattcttctttcagatgctcagcccagtcatttgtaatcggtggcatactctgttctccaatctgttccttaaatttctttataatatacgtgtgtattataaactatcaggccctgttttgcaaacccgagaaatgcgcagattcctttttctttggcacatcttgtgataagataaatatgacaaaggaggattgtcgcatatgaaaacttcaaaaatggaaaatccccactctctgtccatctcgattgtattcgacggactcctggtggggatatttgccggctgtattgccgtcatctaccgtattttattaaatcacgcggagtctcttttattccgcatcatagactttacaaagggaaacgccttctatattgcaggctggtttgccgttctgattatcctgggtctgatcgtaggaagactggtcaaatgggatgaaatgtgctccggaagcggtatcccccaggtacagggggagatgaaaggatacataagtcaaaactgggtcagcgtactgatcacaaagatcacaggcggcactctctcgatcctcggcggtctgtcccttggacgcgagggcccctctgtccagctgggcgctatggccgccaaaggacttgcaaagatcacaggaaagagcaagacaaaagaaaggatcatggaagtctgcggttccggcgcgggtctggccgctgcttttaacgcgcctctggcaggcattatgtttgctctggaagaaattcagaagaactttaacagttccatgctggtctgtgtcaccgccggtgccctgacctcggattttatctctaaaaatgtattcggattgtctccggtgtttgagtttcagctgaaatctgcccttccgcttaaatactacggccttttgatcctgctcgggatcatcctcggcgctgccggggccttatacaactgtgtcatgctgaagggtcaggatatttacaaaaaactttccttcctgaaaccggagtacaggaccgtaatcccgttcctagtatcgggtgtgctgtgctactgccttccttccgtactcgcaggaggccatgccatgattacacgcctggagagcggccatctcctgatcgggtctatggtgcttcttctccttggaaagtttctgttttcggcagtcagctttggctccggagcaccgggaggcatcttcttccctctcctgatccttggtgcctacattggttccatctatggaacctccgtcacaggacttacaggcatcagtcaggattacatcatcaactttattatccttgctatggccggatttttcactgccatcgtcagggccccgatcaccggcgtcattctgattgcggaaatgacagggacatttgaacactttctttccctggccgttgtgtcactgactgcctatgtgattgcccatcttctgaaaagcgagccgatctacgagagtcttctgggccgcattctcgcaaaaaagggattaaaaacaacggatgccgcagagggtaaagtactctcaagttttgttgtcggaacaacctgccttgctgtagggaaaaaaatcaaagatgtggcctggccggaacactgcctgatcgtcaccatcagccggggcaaggaagagatcatcgccaaaggaagcaccgtggtacactccggcgatacgctagttgtcctggtggaggaagactacctgggaatggtgacggaaagcttccagcttatctgcggagagattacggcgggatagacatttttataatcaagaatttcgttaaatagtgaatatgaaagcgaagaatcgccagttccgacatctgccggaactggcgattcttaattaagggcttattttacagccccttatagaaatattttgcaagagttaaacacaaatataataagcagtcatgattctgctaagcatacatcagtttcccctgaggctccggaatttccctgcccatttcttttgccgtttcaatccattctttgatcacgatctgggcattgtacagtgcatcctcctgtgtttttccatcagccatacatccgggaagttccggcacttcggctatataacaatcatcatctttactccagtatataataatttcatatttaaacattagctatacctccaacttatatttcagaatcaagtttctaatttgctttacttggtaaggttttgccttatttccttttggctgtatattaataatttcattaattccgtctttataatatataaagtggtctccttttattctacatctaaaacccataacgtcaagcaccctttgcaaatctctaaacttaatattgctgtttttttcagcacatattatatcactaattattttttctactgatggcattgtaatacctcctttatttgatattacaaaaataatatatctgctgacctatatatccgcacatctatttttaccatatttttactattcttgtatatacaaaagaggaataacttacagataataccataagttatccccttctataattttactttctcttccgtctccggctgctcttccagaataaaataccagctgcaccggctatacatccggacagccacggcactctgttctcatccccggtctttgccgatgatgccgtttctgtgccgttcttagtgagctctttataatttcagctttcatcctttttgtttttcgtttttttgtctcctgatgtttcccccatctcctgtacatttaattgttccgctgcttttttccacctggccttcaatgtcatatcctgatgtaccggtgtgctgaaatcccatacagtctcaattccattttcatctgtataaaaccagccctcaaaagtatatccttttttctgcggctctttcggcttgactgcctgtttacctccttctaccttctggacatccggagtataacttcctccctttgaatcaaaagataccttatgttcccctgtcagcgtaaccttaaccgttacttctgtaccatccggcatagaaaatgtaagctcaaaactgcctgtttttcctgctgctttcgctccattgatcacatccagctgttttttattgacagtgatctgcgcatcgaccccatctttatcctttccctttgcaccgcacaggtttatgatctcatcctcggtaaaagctttgcctccggtcggctggaccgtgtcatttgctccgatggatgccgaaggagcttccggacggtattcggcattatcactgccctcttttctcagatataccgtaacggtaatctctgtcccctggggtgtctgaaaagacaatgggtagtctccggtcttgcctgatgtcttagctttattgatcttttccaactgtttagcatcagaaaaactcagttcatctatcgtgtacggcgtgccgtcatctttgcttcctgccaggccagtgagaacctttatctgggcttctgtaaaaccttttccccctgtgctgctgatcacatgattcgccatgatcttgtccccgctctctgtcacgtttgtcacgtcacgccctccggtcaaagtgactgtgatttctgcctttttgccatccggagtttcaaaggtaagtgtaaatgacccgtttttattggctgtcttggcatcattgatctgatccagctgctccttggaaagttttatgtcatcaaaaggtatattgtttccgtccttatctttccctttcagcttaccgagttctttgacctcctgctctgtaaaagccggtcctccggattctgactggaaactgtttgcaccgatcacagaagacggattctgcacatccaattctgctgaatctgtcccctcgctccggagacaaatggtaaccgtcactttcgtgccgttttctgtggaaaatgtcagcgggtattctccggtctttccttccttttttgcctgattgaccgcttccagctggctgggatcatcaaagaggatcttactgtcagggattgtagatccgtctgcctgctttccggtcaccttagttaaagcttttatctgtccctgggtaaattcatcgcctcccgttttgctgatcacatgattggctcccagctgctcttttgtatcctggtcgattccattggaatcccggtaaggaccaaaatataccattgtgaaaaactttttaactttaatctctgatttttctgaaaatggagtatcatttgaaaataagtaattatcttctgactctccatcctgaatataaccctgatacctttcttttggaataacatttgcattctttacgtagtccagtcccaatgcagctccgattccgggcatatccgtagactggtcaccgactgctgttaccaccgtatctccaccgctgatctcaagatccacagtctctgtggattgggtgtaagtgccacaatctgatgccccgattcccggagcccgataacctcccctggccataacagttcccccggtaatataaactccctcaaccttgcttccatagccagaaccaatgcctgaaccataagcagttcctgtggcagtaacatttcctccggatattctgatattctttgtatatccatagccgctgctgtaatattcactgacacaggcacagccgatgcctggacagtgatctccgccggaagcctctatattccctccctctatggtaaagttagagaatcccatctcctcttttgttgtacccgaaccataagtatttcttactgtactcccaatagatcctgcatgcgttattccagggtcccctttggccgttaacgatccacaggacaagttgcacttatgcccctttttgtccgccgattcacactgtatcgtcagactgccgtccatgccgtcttttgccagcgcgcagccctctaaaccatttccgtttccgccggaattacacaaaagctgatttttccctctaagtgttatcgtgacattcgcatgggaaacgttgatgcagtccatttttttggtatcacaagagatgtcaacattgtctaaagtaagatcaacagtgacatccttttccactattacattatattgagtcgttgttcccgtaatccagtatcccttcgggttcagggctgtctcattttccggcagtcctccgccctcggctccgtgttccgtgatccggatatctccctgtcctacatcgagaagggtctgtccgttctgagcaagcttctttttctgtaccgcttttttgactggatttttcaccgaaacagtttctttctctgtctccgtgctgtctgtctcttcctttactgctggctgttcttccgtattctccgtacttcccggctgtgtctgttctggggtctctgtggttccagaagtttcccctcctgtatcttgtgtttcactttccggggctatttcctgtatttcacaaatacccccccccggtttttctagatatttcctcttcatatgctctgagcagtgttcctgcccctgtttctaaagctaaagtcaaagaaacagccgccaatcgtttcatccatggtttcttcattctctctccgtcctttctcatgccctttgcgcgctttccaggcatattttatttgtttaacctttataagaaaatcatatctcacagatggttagacaaagatttaaaaaggcagaactaaaaactgctctgccccttttccactatatttatgataaacctgcttttttctttttccacccaaagatacaactgcctgctgtacaaccaaggagccaaatcagtttcccgtcctctcctgtctttgctgtatccgcacctctgtttttgtctgtctctttatttcccttaacttcgccgtacttccacttgtccttatcatgattctctgatcctgtcctgtcttgacttgctgtggaatccttttcctcccctgaagcagcttcgggaatctttttccatctggccttcagggtcatactgctgttcaccggatctgcaaaatcccatctcttctgcccgccgtcttcatccgtataataccagccttcaaacacatacccttcttttttcggctctctcggttctgccgcaggactgccgcctgcaacaatctggtcgtccgggtgataatctcctccgtttgaatcaaatattactgtgtgatttcccgtcaaagtaacggttacctccgctttcgtaccgtcctccagagaaaaggtaagtggaaagtctccggtctttcctgctttcttgatctcattaattgttcccagctgtcctttatccacgatcactgctgcattattaccgtatttatttttccctttggctttgcaaagttttgtaatttcctcctcactgaagccaattcctccggtaagctgtgcagtatcattagcgccgagacttcctcgctgctctccattttttgtctcatccgttccgctgtctctcagatacacccggatcgtaattcctgtcccgcccggcgtctctatggtcagcggaaaatctccggttttcccattagtcttggctccattgattgctttgacctgtttctcatccggaattactaattctgttcctgcaatggcagaaccgtctccatttagggccgtggcatccgaaagctttatcagctgttcttttgtaaaggcttttcccccggtctttccaatgatatccagtcctttgatctgctctccggtcgtctcattaactgtgatctcatcataagttttcaatactacttccacagtggctttttttccatccggagaagtaaaggtcagttcaaaacttccgctttctcctgctgtcttggcatgattgatcaattctaattgaccggcatctgctgtaaactcgtccaacggataggtcgttccatcagagttctttccctgcaccgatgcaagcttcctgacatcctcctcactgagtgcttctccgccggtatcctgacaaaaatcgtctgccccgatcgttggctcaggctgttccgggtccatcaaagcggaatcagtcccgtccgctttcagatatatcgtgaccgtcgtctctgtcccatttggtgttgcaaaggtcagaggaaactctccggtttttcctgaagtctttgccgcattgatcgcctggatctgatcttctctggtaaaggttaaatctgatgtattaaaatcgattccattttcatttttccctgttaccttcgtcaatccttttaactgttctttcgtaaaaccttttcccccggttttactgatcacgtggttagctccaatctgatccttcgtattcttttctatttcattggtatcacggaacggtccgaaatagaccatcgtgtaaaattgtcctacccggatatccgtcttttctttaaatggagttccgtccgcaaatgtatattctgtctcggaaataccatcctggatataaccctgatatccaaagtccggagctgctgtcacattggagacataatcatttccgcttgcggctccgatgcccggcatcccggtttctttgtcacccaccgcaatgacgactgtatcccctccgctgatctcaatattttttgtttctctgcttcttccatcatttgacgctccaattccaggagcatgtcctcctccgtaaacttctactcttccgcctgaaatatagactccgctcgaattctcggaaagacatgcagaaccgatgcctggagaatggatacctgccaaggcttcaatattgcctccccgaattgtgaaattggcaaatccgctctcttttgctttctgcatattccgcagtgtacttccgattgctcccacatgccataattcaggattccctttagcaagcagagaaccgcatgacttgtcacatttatgtcctttttcatttgcgtgttcacactggagtgtcagactaccgtccatcccatcctttgtcagagcatttccggtatttacaaagaacccggttacagatgaacccgtattgcatattagcttgttatccccgatcaaggtcaacgttatgtctgcatgagatacattgatacagtctcttttcgttgttgttgtatctgccttacctatggtaatacttacatcctccagagtaatatctgtttttaccccttctgatacttcaatgttattggaggtcgtagtcccggtgatccagtatcccttcggattcaagcttgattcactttgctgaagtccgcctcccgtcgctccacttaatgtaatacggacatctcccttgctcacatcaaggaagatctgtccgttatctgccagctgctttttaagattccctttggttttctttttagccgcggcagttttaccggaagcttggatttccttcggtttttcctcttctgtactgctttgctctgtggctgtaccggcctcgcttcccacttgctcttccggggtcagctcctcaattctggaaatacccccccccggattttccagccatttcctctccatgggctttcagaacagttcctgctccggtccctatggtcacgatcagagaaactgcggccagacatcttatccattgctttttcattgttctctccgtcctttctttttacgtcctcaagtgtactttcttttggacatttcatttttctttgactttataagaaatccggacatgataaaaagttagatagtctcctttccatcaaacaattacattcctttttgcgtaaaaaatatcatatataataaattataagaaaagagccgccgcccacaaagtggaagcctttagggttttttacgtcctataaaaggacgcgccaatcccgtttgccgacagggtaggtattttttatttatagagaaaattaaaaatcctctctataaataaaaaacactttgcgaaatgcacacagatgcataaggatacaatttgccttcggcaaattgtatgtggcgcgcaaagcgggcaggccaactttgatttttcgctttttattcctatcaatgtaggtcagcatgcgatcaggaacgtaccgcctaaaaataaaaggcttaaaacttggtatgtatccatttccatcatctcccttctctttcttcaatagaaattaatttctattctccagttccccaaatcccacttaagcataatttcaacaaaatcacttgttctaaagattgtgagataataaaatacaattataaagtaattcaaaaacttccggaagatggattacctgaaactataacatcaaagtatatagaaaagaggtatgaaattatgaagtggaatgcagtcataacagaaacaggttcagaagtaatgggattattaagggcttcaaatcaggttgatttcagaccgaacgatagacccactgatttagcagattattctgtgtcatatgaaggccgtccgtcagaagatctaaaaaagggtgacaggatagaaattggcagcagttcattccgtatcgtaggtctcggtgcaaatgtaaacgaaaaattacagacacgcggtacctgcacgatgaatttttcagaaaaacacacaccggcaacaccggattctatcatgctttcaggtattggatatcccgagacatgtattaaaaacggagcaaaaatcagcgtcaaataatcaaactcatttgtttgcagaaatacccaacgcctcagattctgatttctaaaaaaattctatgataacctgcggagaaaggaaagatagtgaaagattataaaggaattgtattttttgattacgacggaacattgattgatgaagtggacggtatttttcagatgcccgattccacaaaagaagctttaacaaagctgagagaaaacggatacgctgtctgtatctgtacaggcagaacaaagcaattttccgaagatgtaaaagaatacttcaatggttatgtaaccggagtgggtgcctatgtagagattgacggagaggtcattcagagcatagagatcacagaatctgaaatcgagaatctgaggcagatttgtgcaccgagaaatatcgtgcttctgatggatggagaaacacaatcctattgcgacggcatggagcaggaaagctatcagttttttaaatatgtgtttgatgtcaaagaccattgggtgctgccgtgggataccaaagagaaatgccggattaataaactgacctttttttatgatcatgatgaagactatgatttcctgaaagcacacctttcctcccggtttgaattggcaaaacatatccggtatcattttacagatgccacaccggtcggggtcgataaaggttccggcatccgtaccatgatggatgctttaggaattccaattcaatcaacttacgcattcggagacggtgataacgatgtctccatgataaaaactgtgggaacgggaattgtcatgggacgtcactacaaaggattggatccttatgcggcatttacaacggatactgttgcggaaaatggaatctataacggctgcaaaaaactcggtcttatttagctttgcggggttcaatcatgagaaaaatcatagacgatgaaagattaatctaccagtgctgcagtctttactacgaagaacatatgggacaaagtcagattgcaaaacacctgggaatttcaaaatcctctgtctcaagaatgcttcaaaccggacgcgaacttgaaatagtggaaataaaagtacgccatctggcacaatatatgtatgaggatctggaagaagaattaaaaaagaaatatcacttaaaagatgttgtcgtagcagaaagcagccctctggattccaagacagagcgtatctcaaaactgaacgaacgggcagctgactatctgaaccgtctgttaaaagacggcgattatgtcggagtatctgtgggatccagtattaggaatctggcaaaaacgagccatgaagcgtttcatagaaactgcacctttgttcctctggtcggaggcatcagccagcatactaccgggatggaagaggtacagtccaatcaggtggcggaagctttggccgaaaaatatggcggaaactatgtgtctttcttttctcccgcagtcttctctaatgaaaatctgatgaacgaatttttaaaagaggaagcggtacgctttatctttgattactttgaaaaattagatattgtcatttccggtatgaatattgccagttccatgtatgagactgtgaaaaagctgggatatgtctccgatgatcagctggacagattcaagaaaaacggtgccgtctgcaatcttatccttcgattccttgaccaaaatggaaatacagagccttttgatgaatataaccgcaagattgcaggaatctcggcagaagcctataaaaatgtagaacataagctgctgatcacaggcggggcgggaaacgccgctgcggtaaaaagctgtatcaggggaaattttgcaaatatcctgattatggatgtggattgtgcaaaggcattgcttgttgattaagttttataacataaaaatacaggcattcttaatcaaaagaacacctatatttttatctgctacaatctattcttcattcaataaaacactgactctgtacattcccggaacagatgcatgttcatatgccttctgtatatcatccagaagaaacttctccggttccactagcttggatacatccacagctccggtatttaaaagttcggccgccttgaaaaagtctttcatgtccgctccaaaggtgccgatcaattccattctgcggtaatggatcacattggaatccagttcgatctccggagcgggatagcctgcggcaaacatgagaatccgtccgtccagctccttcacaagctctgctgcctgggtgtttgcctttgtgtttcccacggccacgatcacagcgtccgctcccttttgatccgtcagttcttttaccttttccaccgggtcttctttgctcacatcgatgacttcaaatcccatatctctggctgcctgaagcttcttttccatcagttccgtcacaatgaccctgcaatttttggccttggcagcctgcgcattgacgagccccatagtccccgctccgatgacaactaccgtctcctgaggttccagccgcagtttggagattcctttgcacacggttgccagtggttccagaaaagctgcttctgagggaggaagttccgggttcattttcacaagatttctggcgctcctcacattgtaatctgcaaatccgaaatttcccctgtatccgtcttccgtcaggtttttgtaatccgcgctggtacactggccctcatggcccctccggcaggcctcgcatttcccgcatgagttatatgcgacagccacatgatctcccggttttaaatccttcacaccgcttccaaccgcctcgacgataccggagccttcatggcccccggccattggatagccctgatgttccctgagtcccagccattgcccgtagtctgtggtacaaatgttgcagaccagctgttttacgagcacatcatcaggacccatatccgggatcttcctcactcctgtcagggcgcatcctttttcttttaaatacgcaaacttcatctgttctatactcattgatatcctcctttacagccggtccgttcctccgaataattctacataatgtttcagcgccgtcttccagccctttgtcccttccacgatggcatcgtacaggttagcattcaaatttccaaactctcccttttcagcatccttcggtatgtggtcaaagttcactccgagataagatttcagggaaacgactccctccgcactcaaatctgtaaacagattgactttctggattcctgtctctactgcttttttcaaattctcatctccggtgccggaaccgccgtgaagcactaatggaatctcaatgctctcactcagctctttcaagagctcaaattccagatgcggagtccctttatatactccatgagaagtccccacagccacagccaggcagtcaactcctgtctcttcaataaaacttaatgcttcttttttgtctgtaagcccggagtctctggttgattcatattcaaatccctgtcccacatgcccaagttccgcttccacagagacacccaccgcatgggctgccttgacgatttcttttacttcccgtacattctcatcgtaaggaagttcggagcggtctaccataacggaactaaatccgcttcggatggcgagcatgatctcctcatacgccccgccgtggtccagattcagcgccacgcacgcctccgggtatcttctctcataaaatctgctgatataagccagttcctcaatcccatggcatccggcgccgtctagaataaccggcgctttgaattctgcggaagtctgaaatgcagcttctattgtcttatcgttaaatacattgggcgcagccacgccgtaatgttcctgttttgctttctttaaaatatccgccattgaaatgatcatgttttatctcctcctaatttaaaataatccgattgctgaaccaagcagacacaatccaagaagagcaaataccactcttccgaatttctgtccttttttcctaaagaatatgtagatccctacgattaaaagcagcggaagcagtcccggcagaatactgtctaaaatggcctgtaccgtggtcgtggaacctcccatggcaaacttgatcggaatttccaattttactgtactggctgacaacgctcccatcataaacagtccgagaatactggaacctgtgatcagctgtttgatccatccggactccagcagcatggataccgcgtttcttccgagtttatatccaaggttggtcaggtaaaatccttccataaacgggatgactgcaaacatgaaacatatgaaaaatcctgcaattcctccttttgcactgaagcctgctgccagggaaaagatcagcggcttccatgttccccagtcaatggtatcgccgatgccggccaaaggccccatcagccctgtcttgatacctgtgatggcctcgtctgccacttcgctgccctttgccttctgctcctccatagcaatggagattcccagcagcggagaaccccagataccctgggtattaaagaagttcaggtgccgctgaagagctttcacataatcttcttttttgtcatagagtttctttaagattcctgagattgaatagcagaacgccacggtctgcatacgttcataggaattggacacttccacagtattgtaccagcgcagatacgctttccttatatcctttttggtgatttctttgttttccataggtacctcctccctattcgtcatcgtcgtcacagatctgaagtttcttcacccgctgcatgatctcttcctgtccgtcgttcttcataaataaaataaccagcgcaatacagattccaaaaaccgcggctgccatcgtgttgatctttaaatactgaactgcaaagtatcccatgaagtagaacggaagcagggatctctgcccgatgacgaacaaaatgatcgcaaaaccaagggcaggcagcacgcctcctgttactgagataccgtggatgatccactgaggcatggcattcaggaatttctccacaacgtccgctccgaaatagttggcgatgaacactggcgggaatctcatcaggaatcccactgccatcggataaataacagcacaccggaacagtcctttttcatcccctgccagggcatatttatcggcgacatgggcccaccgtgcattgacggttcttcttaactggtccaggaaaactcccagaaccccaaacggcacggccaatactaccgcagtagccggatcagcgccgattttcatggcgatgggtatagcgatcacacccgccagacattcatccgccggaacatttgctcccggggagatgattcctacatatacaagttcaatggcggcaccgatcatcatggcctgaggcacatctcccatcagcaggccgataggaagtgccataaccaaaggctgtttcagcacataatgaaaggtatagcccggtgctcctcccgcaaaccaaaaccatatacccacaaaaacggcaattacaaaattcatatctttccctcctaactttctctgtattttttctcaatctcggcaaacggcattttcacttcctccggcacgatatggaccgcaacttccaccccgctctgatcaaattcccggagcagagagatatcttcttctcccagcgaaaccgctctcaggatcacctttttatccgatgccttgggcagtccgcccagctggacatattccatcggcacaccctgtttgtacagttccagacatgttttaatgtccttaaacagaagcatcacttctccatctttatactggttcttttcccagagccttacggctttcgggatgtcatagatttttacttttacatctttaggcgcggacgcctcatagatgtggatcataaaatcatcttttgccagttcattgtctacgataataatttttgtcaccttatgtatcttgcgccatttggtgattacttgtccgtggatcagtctgctgtcaatccttaccaatgatatcttcgccatatgctatccctcctattttgatttttcatagattgccatgcagtcctctttcctaagtgttacaaagcctcccaccggaccgtatttcgtgcagttctctgccatttcttcgattctgtcaccgtcgattcctgcttcttccaatgttaccggcatacccacagaccggaaaaaatcccgtgtccttctgatgccttccagagccgtcttttcaggatgatccatgttgttttccacgttccagacattcaccgcatatttcacaaaacgggtcacatctgtcttgtacacatactccatccagttcgggatgatgatggataaggtagctccgtgtgtcagaccatagaaagccgtaatttcgtgtccaagcatatggctgccccagtcctcgcttcttcccactcccaaaatcccgttgtgggcaatggtcccggtccacatgatttctgcccggcccgcatattcctgagggtggctaagcacttccgggagacagccgatcactgtcttcatcgtggcctcgcaaagcctgtctgtgaaaccgcagtccggctccagtgtaaagtaccgctctgccacgtgtgagaaaatatccacccctcctgccgctgtctggtaagccggcagagaataggtaagttccggattcatgatggcaaacaccggtttaatgttgtctccggatgcggccctcttggaatgtcctccctcagagttcgtgacaaccgttgtattgctggcctcgcttcctgtcgctgggatcgtgaggatcactccgacaggcagtgcctcttcaatctgtgcttttcccacaaagaaatcccacacgtcccccggataagaaactcccatggcaatggcctttgcggaatcaataacgctccctccgcctgccgccaggataaagtccagtttctcttccctgcaaagcctgatgccctctctcaccatttccacatccggattggctttcacgccgcccagttccacgtattcaatctcatttgccttcaaagaacggatgatcctgtcatacaggccattttttttgatatgtcctcctccatagtgaagcaggatccttttgccgtactttttaatttcttcccccacgctgttctctgtgtcttttccgaagataaaatccgtcggacagataaatctgaagttctgcatgatattcttttcttcctccttattcctctaagtctctgttcttttccctgccccaggaaagcacctcttttgcaagtttcttcccgctcagttcttccctgagttcttcggccgctatgagcatttccattcccagaccgcagagggcatgtacattttcataggtcttgctgaaaacagccgccacgttagaagttgttcccccatttaagtccgagatcagcaggatatcctgccctttgctcttttcaatcaccaccctgatcttttccatgtagtcagccagcgcatcctccggttccagggcaaatgcctctgcatcgcggatctctcccacgaccagttccgccgactttatcaattcttcaccccagcacccgtgggtcaaaagcaatagttttgtcatacttcacctcgaatcatctctcttgtcagactgacaggttcactgtccgggaccatctgaacaaatattttcgttccctggtccagcagccgcatcatctcttccccctccttttctccgataaaaacattgtcacaaatttttttcttccccctcatataagggagccggccaatgttgacggattctgtcaaaattcccgcatcggccagtctgcacactgtctccagttctttgatcagtataaaaatgtcttctgtatcctctctgatcttcgtccgtccttcaattaccgtcaaaaattccgctttcacattccccggcaccgacatcttcagcacactttggatcacaggatctgctgccacctggttgtccacgataaaaagcctctcacatcctgtcttctttagccatttcagcagaacctgcccatggatcagcctctcatccacccgaaaatatttcatatcgatcacagcttcctttctatcatccgatgagctgtttcacattgacaatacctgtcttaccagcttccatagctacttttggcatgctgcggagggtgccgtcttcccgttcttccaggactgagataagcataggaagatttaatcctgtgacacactcaaggccttcctgcttcaaacaggacgccgtcacgttacacggactgcctccgagcaagtccaccaatacaaggactccttcgccgtcgtccagctcttttgctctttctttcacctgtcgcgtcaattcctccacatcatccccatgattcagcgtgagcgcttcaagcttttcctgcctgccaaagacaagctccatgctcttgataatcgcctcgctgaagtttccatgggttaccaatagtactccaatcataagttcacctccgtttcgtgtttgtcatttatatatagagcaaaaaccatgccaacttagtgtgttatgacattttcaccagttctgcggcttgcattcgaactgatgaaaatggacgtaatatctgccagggagggtgttctttatttttatttgtggtctttttaataaaaataaattctctaattatacgacaaaggaccggaacactgctgcatgttccggccctttgttctgcctgtcttcttttcttatttaaatatcttgatggcctcatggatttttgtaaaatctatctcacagagtccctgaaagatccccatcggaactgtttcatcaaatccatagatgctcaggtctgcgtcctgttttaaatcgtaaaccagtatcctttttttatccggatctatgatccaatactctctcactccggcctctgtgtattttcctaacttgatcgtcagatccttcttttttgttgactccgacaatatctcggcgacgaagtccggtgctcctaaaattctgccctctctgaacttatcgcggctgcatacgatcataatgtccggctgtacgactgtcttgtcatcacaatccagctgtacgtcaaggggtgcctggagggggatacagtctcctccctgcctgtcaataaaatcatatattctgcggtacagctgtccggcgatcatctggtggacataggtcggagctcccatgtcgtagataatcccgtcaatcagttcgatccttctgtccgcagaaatagcatcataatctgaaatggtgcagttttccgcagtactgcccgaaatataatctgccgattctcccagttctgcttcggattccctgttaaggactttttccagcgctctcagtgtctcatatctgggagattttgtgactcccccgaagattttctgcactgtgcctacaggtactcccgacaatactgaaatctgctcgtaagaataccctaattctattttcctttgtttcatttcttccatcgtcatagaacccctccttcaatgccgcatacaccacacttaaattataaccgctttatatccgtaaaacaaccgctttttctccatatttatgccattaaaaagtctgattattcttgtttttatctgtcattaggagtaaaatatagttatcaactcatattaagaacggactataaagacattggaaaggaggattttgtcgatcgtatccatacaattttataccccaaaaaggagggactgcgatggaacttcagaaactgcattatgatgtggcagacggaattgcgactataacaatggactatccgaaaaacttaaatgccatcgacgaacagatggcagatgaactgatttatgccgtagaaaaggctgagtcagatccggatgccagggttgtggtattaaagggcgcaccgaaagcattttcggccggcggtgatatcggctatttttatgacctgatcaaaagcggcggcgacatcaatatggacggactcatcggcaaagttggaaaggttacaaatggcctgaaatccatgagtaagatggtcattgtagcagtcagcggcgctgcggcaggtgcaggtttcagtcttgctctttccggcgatttcatcattgcggcagacaacgcaaagtttattatggcatttgtaaacatcgggctcgttccggataccggcggtgcttatcttcttgcaaaagagatcggcgaaaaaaagacgatggaactgtgtgccaccggacgtcctgtagatgcccaggaggccaaagaccttggttttgtttataaagtcactgcaaaagaagatctggatgcggaagtttacaaatttgccaaaagattagcatccggaccacaggtatcctataaaaatatcaagaaacagatctatgctgcggcattctctgattacgaacgctatctggatgatgtggaaatcccaacgcagcatgagtgttccaatacagaagacttcaaagaaggctgttctgcattcatggaaaaacggaaacctgagttccagggaaaataggcagcacactgaaaggaggtaacgatattgatctcaaaagtagtgtctaaagaagaagcaatcgcaaaattccatgacggccagacgatcatgtttggcgactggcatggagagcactctgcagaagagctgattaccggaatgctggaaaaaggggtaaaagacatttccgctatcgctgtatccggcggtatgcctgaccagggactcggaaggctgatccacgaaaagctggtaaaggatctgattacaacccacatcggtctgaatccggaagcccgtgatcaaatgtttgcgggtgagttaaatgtagaatttgttccacagggtacttttgcagaacgcatccgctgcggcggagcaggtctgggcggctgccttactcccacaggcgtgggaacagatatcgagaaaggaaaacagaaactgaccattgatgggaaagaatatctcctggagcttccgctccacgcagatgttgctctgatcaaggcatggaaagccgatacgatcggaaatatcgctttccgatacaccggaagagccactaacagctacatggcttttgcagcagatatcgtcattgtcgaggttgaagaattggttgaagtaggagaattaggtcctgatgatattgatgtgcctgctccaatcatcgatatggtttacgtaagaaccggcgaaaagaaacctttctgtccgatgtggcagcgtgcgagagcaaaagcagaaggaggtggaaagtaatggcaggacttactggacgtgcactgatcgcatcccgttgtgcgagattttttaaagacggagattttgttaatttaggaatcggggttcccatgatgtgtgtcaactatctgccggagggtgtagaactttggctggaggccgagatcggcattgtcggctgcggttccacaccaaagtgggaggatgcagatccggatattattgatgcgggaggccagcctgcttccatcatcaaaggaggcagtatttgtgaccacacgacttcttttgctttcatccgcggcggccatgttgacgcaaccgtactcggaacgctgcaggtagatcaggaaggaaatatagccaactggaccattcccggcaaacttgccccgggcatgggcggcgcaatggatctctgcgccggtgtaaaaaagattattgttgctactgatcactgtgaaaagagcggcgcttctaagatcctaaaaaagtgcactcttcctctgaccggagctaaatgtgtcactgacatcgtaaccgaacggtgttattttgaggtgacggacgaggggctggtcctcagagaattagctcccggctatacggtggaagacattctcgcctgcacagaggctgatgtgatcgtgcctgatgaagtgggagttatggaataatggcaatttctacataatttccgttcggcacttataatgcctcactccaatcatgcagaaaatggacgtaatatctgctggataagcacctatcaaacaaatgcgcggcataaacggcagtaataaatttttattttggaaacaggcagcaaaattctaaaaatttgctgcctgttatttataattctattccctgcttctctttattacctgaatgcccaccaatgaaattccaagaatcagaatcaagaattgtatatctgccgaatctccggtctttgccataggctctgtcttctttcttactcttttttgatactcccatttaggtgcctgtttctttactgtcctgtcttcgttttcttctgtctcaaacccattctccgcagttgtcccagattcctccgatgttgattctgttctcttaggctcttctttccattttgctttcagcgtcatattttcatacaccggatctccaaagttccattctgtttcgtttccatccttgtctgtataataccagccttctaatacataacccgcttttaccggatcttcaggtttttgtaccttctttccgctgtccgcggtctgcatttggggcggttcgctgcctccatctgtgtcaaaggatacttccactgttccagtaagcaagatttccactgtcactttttccccttccggtgtctcataggtcaatagaaatttccctgtattctttgatgtttttgcctggttgatggctttcagctgttcttcgtctatcttaaaatcttccagctttaaattattcccatccttgtctttgccctttacaccgcacagctcttttatttcttctactccgaaaccttctcctccggtctctttttccacattattagcccctaccatgccggatgcagttccgctgtccggagccgtcacatccgttccatttcctctcaaagagactgtaatgactacctgagtgccctgttctgttgcgattgtcagaggatagtcaccaatctctccgtttttcttggcctcattgatgacattgatctgatccctgtcgggcagtgtaaaatcttccagatcaaatggaatgccgtccttgtctttcccgtttgctttcgtcagttctttgatttgttcgtcagtaaacccttcaccgccggttttgctgatcacatggttcgcacccagctgttctctgctgtccagatcaattttattttcatcccggaatggaccaaagtaaaccatcgtaaaatatttatctaccttaatatcctgctgctcctgaaatggggattcctctgtaaaatcatactctgttctcagaagtcccgtcctggatgtagccctgatagccagagtccgggactgcgcatatgtttgtcgcagtacctggtgtcttcgtaccgtatttaccgcatccgattcccggcatagatgtattcttgtcaccgacagctttgaccagcgtgctgcctccgctgataacgatgttggaaacattgaagccctccggtgttttctcccattctgactccgtcgtctcagcaccaccggacccgataccgggagaatatttccctccggacgcataaactgttcctcccgtaatatagattccgtctaccggagttacctttcctcctccgatgcctgcgcagagggttccccctttcgcagtgatgatacctccctctatgcgaatattttctgcatattgttttgtatcggttcccccattggcataacttccgcaggctgcgccgatggcacagttatgttctcctgcctgtgcattaacaataccgcctttgatggtcagattggaaaatccggattcttcctttactgttctgtttgcaatgatatttccgatggccgttgtatgcattttggttccttttgcctccaaagaaccacaggtgtctttatcgcactgatgccccttctctcctgcatgttcacactgaatgataagctcagttttatccatgccttctttcactaaggctccatagttctgtacaccacaagaaagcatgttgttccccaccaatgtaattgtcacattggcatgtgaaacgtccatgcagtttttgcttccgctgttgctggtgacactgacattgtccaatgtaatatctgtcgtgactcctgcttcgacttttatataatatgaagtggtttttccgataatccggtagcccagagggtttaaagatgtctcactgcttgtaccccccccccggtcgctccggagctcttaatcgtgatatttcctttgctcacgtccaataaggtctgcccgtcggctgtcttttttacaggtttctgaacttgtttcacctgttgaacagaacccttttttacagcgtcttctgtcggtttacaacctgaaacctgttctgtttcttttggcaagtcaatatgctcttttacagtttccatcagtatttttgtgtcaagttctgtcccatcctctgttgtctgtgttatggcttccactgagccttctgtctcctgagcttcagctaaaattgttccatgtgctgccgtaatcgccaacaccatggaaatcatccatatacgttttcttttcttcatttttgtgatccccctgcattaaatttgccttttccacttcacagtttttatatcaggtccggtttggattatggatagttagattttatatgcaaattttaatcacaaaaagccggagcatcatactgcggtgctccagctgcaattatttcattttcttatagatcaatcctgcccctgtcagagatactccaaagatcataaagagatataagacttttgtttcatctccggttttcgcagttcttgtaacagtctgttctgacttcattcgtttgctgtactcccagtccgggatggttttctcagttgtagatggttttactgattcggtcttcgtttctgtcgtagacatggtctgttctgtgtcctctgttctgggtacttccttccacttagcttttaatgttatattctcatagacaggatcttcaaaattccactctgtttcgtttccatctttgtctgtgtaataccagccttcaaatacatagccttctcttaccggatcttctggtcttactacttttttaccgctgtctgtactctgcatttccggcggtctgcttcctccatttgtgtcaaaagatatttcgaccgttcctgtgagcagcacttccaccgtaacttttcctccgcccggggtctcataggtcagcgggaactttcctgtatttttagaggttttggcttcattgattgcttttaactgctcttcatctatcttaaagtcttccagcttgaagttgtttccgtctttgtctttgcctttgattccgcacagttctttgatctcctcttcttcaaacgcctttccgccggtctctttctccacgtcgttggctcccaccatgccggtttcagttccgccgtccggtttcgctgcatctgttccgtttcccctgagagagaccgtaatcgttacctgagtgttattttctgtggcgatagtcagcggatagtctccgatttttccgttcttcttggcttcattgatggcattgatctgatcttgattcgtcaggataaaatcatctaaattgaacggatttccgtctttgtccttcccatttgttttcgccagctccctgagctgttctccggtgaatccctctcctccggtcttgctgatgatatgattggctcccagctgttctttcgtatccgaatttattttattttcgtcacggaatggtccgaagtagaccacggtaaaatatctgtctaccttgatatcttgattctcctgaaaaggtgattcatctgtaaagttatattctgtttcagaaatgccgtcttgtatataaccttgatatcctgtatcaggaaccgctacaacatttcttacctctccagttactcccagatcggattttccacagccaatcccaggcatatcagaatctttatgaccaactgccctcactaaagtattccctccactaattataacatttgatatctggaaataagaggataggctcggatcaacacttccaccagaacctattccaggtgcatttttgcctccatacgcgtaaactgtcccacctgttatgtatattccatcaacggggactcctcctccacctcctataccagcgcaataatctcctccttctgctgttacaattcccccattgatacatatattttttgtatattttccactctttataaagctcgcacaagtagctcctatagcacaattatgttcaccagcttttgctctaataatgcctcctttaatcgtcaaatttgaaaatccggactcatcttctatttctctattttttgtaatatttccaatagccgttgcatgcgttacagtcccttcagcctcaagagacccacagaattcttctgtacactgatgccctttttcacctgcatgttcacactgaataatcaattcagtattatccattccgtctttcaccagcgctccataacctgtaatcccacaagaaagtgtgttgcttcccaccaatgtaatgctcacattggcatgagaaacgtccatacagtttttatttccgctgttgctggtcacgctgacattatccaatgtaatgtccgttgtaatacctgattctactttaatattattcgaagtggttgtacccgtaatccgatagcctttggggtttaaagatgtctcactgcttgtacccccccccggtcgctccggtacttttaatcatgatacttcctttgcttacgtctaataatgtctgtccttcagccgtcttttttgcagtcttctgcacttgtttcttactgggttttttaatgtcgatttctctctgatcttcgtttgaaatatgttttgcctcttccgacagatttatctgatcctttaaattctccataagtgcttttgtatccaaaatctgttcagattctgttgtttccgaaattgtttcttttacggcttccactggacttccagtctcctgagcctctgcaaaaacagtcccctgaactgctgtcatggccacagccacagcaaatatccagattcttcttttcttcttcatctttgtgatccccctgttattatttttccacttcgagtttttggtttttatatcaggtactggtcctttattaaaaagttagttcccttttgcctcaaataaaaccagacagcaaaatatcgctgcctggctttatcataatatatgtagctttacataggttttaaatttttattaagccggccgaccatccagcttatacgtttctcccttccggcatccgtttttgcatcaaaatatgcccgcgtatatgtcttctttaccgacggggacatctgctgaaaattggagtaagccggttcatatgctctcagcagagcagataaaacatcgatttcttcctctgtaattactggtttttggggagcatcccattgaccattttctttagcctgctttatcttttccttgccatgatcagtcatcattccttgcttttcaagtttcttggccagcactttgttcttctcagaccatttgctgtttttcctgcgcgaagaaaaatactttttgtaactcgtctcatcaatacgtttcatttgtccgtcaatccatccaaaacagagagcttcctcaagtgcctcacctgctttaatggttttcggtccgcctgccttgccgaataacagccatacaccctcactggaaacacaatgatctgatagccagttacgaaagccctctctattagaaaatttcagtatttcacccacaatatagtcctccatctgattactgttcgtccgatacttgaattttcttttatcttaatctctgttcacgaaattgtcaaacaactctgtgccagtcatcgaaataactttttcttagctaaaatgatacaagacaaagaagctcccaaagctatcaaacaataaactatatttgtctcatcccctgtttttgctgttcttgagacagtctgttctgagatttttcgtctgctgtattcccagtccggtacagacttttcagttgtagatgctgattttgtctttgtttccgttgtaggcatactctgctctgtggtctctgttgtgggtacttctttccatctggcttttaatgtcatattttcatacactggatcatcaaagttccactctgtttcatttccctctttgtctgtgtaataccagccctcaaatgtatatccgtcttttaccgggtcttctggctttgatatcttcttcccactgtccgtgctctgcatttccggtggtttgctgcctccatttgtatcaaaagatacttccacagttcctgtgagcagcacttctaccgtcaccttttctccatccggtgtctcataggtcagcggaaactttcctgtatttttggatgtcttggcttcattaatagctttcagctggccttcatcaatcttaaattcttccagtttcagattatttccgtctttatctttgcctttgatcccgcacagttctttgatttcatcctcttcaaatgccttccctccggtctctttttccacgtcgttggctcccaccatgccggactcggttcctccgtccggctttgctgcatcggttccgtttcctctcaaagagacagtaatcgttacctgagtgttattttctgtggaaatcgtcagctggtaatctccgacctctccgttcttctttgcctcattaatgttattgatctgatcttgattgggcagagtaaaatcttctaagttaaatggattcccgtctttgtccttcccgtttgctttcgccagctctttgagctgctccccggtgaatccctctcctccggttttactgataatatgattagctcccagttgttccttattattcggattaatcttattttcatcccggaacggaccaaaataaaccatcgtaaaatatttgtctactttaatattctgcttagcttgaaatggtgattcctctgtaaaatcatattctgtctcggatgttccgtcttggatatatccctgataaccggtgtctggaactgcagctacattagaagcgctgcctatcacagcgttccctgctttaccgcagccaatccccggtacatcagtagttttatctccgactgccctgactaaggtatttcctccgctaataataatattagatacattataagcctcaggcataaaatcctctgtcccatcaacaaatcctccagaaccaattccaggagaatattttccgccagttgcataaacagttccccccgttatatagattccattaacaggagttaaccttcctccacctatgcctgcacaatcctctcctccttctgcagtaacaattcctccgctaatccttatatttttcgtaaatttcccaccatttgtaaaactcccacaggcagctccgatagcacagttatgttcgccagcttttgctttgataattcctcctttgatcgtcaaatttgaaaatccagactcgtccgctactgttctatttcttacaatatttccgatcgctgttgcatgtgtcgcagttcccttagcctcaagagaaccacaagcattttccgtacactgatgtcctttctcatctgagtgttcgcattgaataatcagttttgtgtcatccattccatctttcactaatgctccgtagctctgaattccacaagaaagtatgttactccctaccaatgtaatagtcacattagcatgggacacatccatacaatttttattcccgctgttgctcgtcacactgacattgtcaagagtaagatctgttgtaacacctggctctaccttaatacaattcgaagtggtggttcccgtaatccggtaaccgttggggttcaaagatgtctcactgcttgtacccccccccggtcgctccggcgcttgtaatcgtgatatttcctttgcttacatccaacaatgtctgtccgtcagccgtcttttttacagacttttggacctgtctcgtactgctttttttcatgtcaatttcttctcggtctttggctgaaatttgttttacctcttctggcaaatctttctgctcttttacagtttccacagatcctgttgtattcaggaccatttcagtcttcgttgtctctgtcatggcttccactgaactctctacatcctgagcccctgcccctgcaaaaacagttccctgaactgccgccatggctaataccacagcgaatatccagattcgtcttttccttctcatctttgtgatccccctgttataatatttttccttttccacttcgagtttttatatcaggtactcgtcctttataaaaaagttagttttccgataaaaaagaaaactaggcagcaaaaatgaatttttgctgcctgatgctgtatactcacagggttcaccgtgttttatacccttcgggtggacgcgctttgcgcgataaggtatacccacagggcacaccgtgttttatacccttcgggtgggcgcgctttgcgcgataaggtataagttatttaccactatttccgtcgcgattttgaaatgcgctcctccaatagcggtaaataactttcgaaaagtggcaccttttttgacagaggcccttctccaacagacattatgtccattttccacatgattggagtaaggcattctaagagccgaacggaaatcgtgtggaaaatgtcatcagtttttttcttttcgcaccggccggatatatttaaaatgtttttccggattaaaataaaaataaatgattctgccgggagtcgtgtcatagcgatatccggttccttcaaaatcaaattctgccattgccttttcaatcttttcctccacacttcggttttcctgctcataatcgaacggaccgtgctcgaaaactacatactcggcttcgggaacatccatcagctgcatctgaggcggtacctcgccggtgtaatccgccggaagacgcacaccatgagactccgtgcgcagaaaaccccagtcacagagcctgccgtccggatcattaatatatgccatgatctggccgctgccgctgttaggctcactccctccatcatcatccagttttcccttgatgctgtcaagcagaccacagatcgtctcataatcctgtccgggaatgagattttgtttctgccaaaaatcccaatacccattgctctcataattcttaatatgcaaatatttgtgtgcgggaatcgttacaaaataaattttaatatcatcttcagatttcttcatgccgatttctcctaatccaaaaaagtagcggtcaaacggagtaatttttgtacgaagaacgactggcttcggccttttccggtattcactcggagtcacgccgtatgttctcttaaaggctctcgtaaaagcttcatgtgacgaaaaaccataatcaaacgcaatatccaaaatgcttttctcactgtcccgcacttctttcagcgcaaaggccaattttctgagccgcagataatccctgaacggaatccccgatatttctttaaactttcttgttgtgtaaaactctgaataacccagccttcgggaaagaaagcacagtgtcagcgcttcatcattatagttcataatacatctgtcaatttcatcaacgatcgcttggatctgcctctgccactcatacattcgtctgttcacctcgtttcaaccaccctaaatttattataaggaaatagactgtcttctgcttgattttacttgctgttatatatcttatcttttttactcaatacctgtcaaaaaaccggaacactaatctgattagtattccggtatgtgttttatcttatcttcttgtttaataaaattcctgcccctgccaatgaacctccaaagaggataaggaaaaacagacttccctttttatctccggttttggctgttttctcttgagccctctctgtctttttccttttgctgtactcccagtcaggcatcggctgttttgctgtggtcggctgttctgaatctgccggcgtttctgttgtaatctgattctgctctataatttctgtctttggcacttctttccatctggctttcagagttatattttcatagacaggctcttcaaaatcccacaggacttcgttcccttctctatctgtataataccatccttcaaaaacgtatccctctcttgccgggtccgttggttttaccactgtttggccgctgtctatgctctgcatctccggagccttcgttcctcctccagtgtcaaatgaaatctccactgttccggtgagcagtacttccaccgttaccttctctccctccggcgtctcgtaggtcagcggaaactttccggtcttctttgaagtctttgcctcattgattgcatgaaactgatcttcatcaattttaaaatcttccagtttcagattatttccatctttattttttcctttgatcccgcacagttccttaatctcttgtatctcaaagccttttcctccggtctctttttctacatcattggcacctatcattccggaatctgtatcactccctggcactgcagcatctgtaccgtttcctcttaaagataccgtaaccgttacctgagttccgttttctgtggcaatggtcagctgataatccccaacttctcctttttctttggcctcattgataacattcatctgatccttgttcggcagggtaaaatcattagtatcaaatggatttccgtccttgtccttgccgtttgccttcaccagctctttgatctgctgctcggaaaagccttttcctccggtcttgctgatcagatgattggcccccagctgttcttttgtctctgagtttattttattttcatcccggaacgggccgaaataaaccatggtgaaatatttatccaccttaatatcctgctttgtctggaatggagattctgctgtaaaattatactctgtctcagaaatgccatcctgaatatatccctgatatcctgcatccggttctgcagtaatattcactgccgtacctttcactttattgtcatacttccggccgcagccaatccccggcatagcggtatctttatcaccaacggctataacaagagtatctcctcctgtaatttgaatatttgacgcattcatcgactcaggatcattcatgtcagcaccgcctgcgtctgaactgatccctcctgaaccgatccccggagaatgggcgcctccggatgcatacaccgtccctcccgtaatataaatgccgtccaccggagtggctctgccgcctccaagcccggcacagtctttccctcctctggctgttacgactcctccttcgatcctgatatttttggcatatttattctgatccgttgcagaattgtgtgtataacttccgcaggctgctccaatcgcacagttgtggcctcctgcctgtgcttccacaataccgcctctgatggtcagattagaaaatcccgcttctgagccaatggtccggtttgaagtaatatttccgattgccgttgcatgttccactgttccctcggctcttagttttccgcatgtcccttcggaacacgtatgtcctttttcatctgcatgttcacactgaatgattaatctggtatcgtccattccgtccttgaccaaagcgccataagctgtcgctccgcaggacaaaaggttattcccgaccagtgtaatcgttacattggcatgggacacgtccatgcaatttttagttccgctgctggttacactgacattatccagagtaatgtccgtcgtaacgtccggttctacttttataatattcgaagtggttgtacctgtaatccggtagcctttggggttcaaagatgtctcactgcttgtacccccccccggtcgctccggcgcttgtaatgctgatgtttcctttgcttacatccaataaggtctgcccgtctgccgccttttttatgggcttctgcatctgcatgttttgtttcttcccagtctttttgatcttgggctgctcctgcttttcatctgaaatctgctctctggcagtttccatgagcacttccgtcttcagaagtttgtcagcctctgttgttgtttctgtcacagcttctgctgtactaccggactcctggtcctctgcaaaaacagttccctgtactgccgccacagctaacactgcggccaatatccaaatgcgtcttttcttcttcatctctgtattccccctgattattttttaccacttcgagtttttatatcaggtgagacggttccaaaaaaaagttagtccaatcagcaggattccttttcttctagaatcatttctacaaggtacgcagtctccgaatccggtatctgcagatggagacaatcctccaggggacgaaggctttttttgactgtatcaaatatgtgcttatatttcttttttaaaatttccgtttcctgatgcggcagaacttcctcctggatcaggcgctccagcatacagcacagatgaatcacataccgcacagccagttctcttgtcacttccatatgtaatgccctgacagattcctttaaggattccatggcctggcctgccatttttttaggattcagaaaatataaaagctgttccagagttccggtcaaaagcttttcatccatgactgcttcatcttttgtctcacagacagtttcagcctgtccctgtatcatctcgctgagccttgccattccgtctcctacaacgaactcgtccacggagataaacgggacattgggaagtttcaaatcaaccgtaccgaccactgcatctgccccggacagatcttcctgcccttctgcttcctttaccgcatccatcccttcaaaatccatacagcggatcttaaaccggctctgctgctctgccgggatcatatccctgataatttcggaaagcttcagtgccgttccctgccctgtaaaacatgtgaccaggattgtatggatattttgttctccatgcttttggtcaaacacctttccgatctgtctcagctccttcgcaagccggtcgatgtccgcacccctgagcatcgcttttcttaccgcctcaatgaccatgatggtggacaccatgggaactgttttcacagggattccggtccgtttctcaatcatttccgggaacatgagaagggagcccatatctgcaagcaccagcactcctctgccttcatctgtttcttttgccagcaccaccgccttttccagtgcctcctccgcaggcacatccagaggcatgtcgatggcatggcagtgtccggtctttaaaagcttatttgctacctctgccatactgctggctgtgctgtccccatgggccatgacgatgaccgctattttcggatagatcgcctcctcatccatggcacacagaaacatggtaaaatatccgatctcctgctttggaacctgtatcccgagttcttcttccaggagccttaacatgacctttgctgtctgaaattcctggggatgattcaggacaatgtcatttaattctttttccttaagcatgatccctttggaaatcctctcggtcatggcattgacatgcatggcaattccgaccttgatccgctccggcatcttccttccaagttttatctccgcaaactgcaggatgtcctccaccgcgtaatacacttttgcgtcaataatcttcagaagatttttcttttcatagtgttccttcttcatatcatactttttgagcagcgcattcatatactgctccagatcatcctcgatgatatcgctgatctcaccgccggatcttccctgctccaggaatttttcgtactttttggaaatctccatgtatggattctcggttcccggctcaccgtcagcctcgctgtccagaaacatatgataatcttcggagtactgcaaaaattcgatcagatcgctctttttctttgaagattccaggcgtccgttctgtatataggacggcaggatttcaaagttgatctccaccacttccttctgttctaccttgaattccagaaatgctctggcgcataagagctggatatcggcagaaagctgcccgatgttccccggacaggaatacaaaagaagggcaatgaccacatctttatatacctggatgggcgccccgatctttttctgttctgccgaaaaaaactcctcaatcagccgaagccgctcgatgagcggccgcttttccagcgatggcagatgaatgaccaccggcatcctccgaaggaaggtcttaaggagggtcgtattcagattttccgtcgtagcgccgataatcaggacactcgcctttctcacttcctctgtctcgccgagcctccggtagcatcccttatccatgaggagaaacagcatttcctgtccatagggaggcaggcggtggatctcatccagaaacaaaatgcctccgtctgccttttccaccagtccgggtttgtccttttcagctccggtaaaagcgccttttttgtggccaaacaactgggaaagaatcagttcctgattctgggcatactccgcgcagttaaagacaataaatccggcatcttccttcatcaccttcatggctttggcatactggtacagtttctccgcaaatgtagtcttacctgttccagtcggacctgccagcagcgtgtgcagaccattgggcggatacagcaccgcagacttcccctgttgaatctgcgttttcagcgatccgtcctccccgatcataaaagcaaattctttcgattccctcttctcaggctccggtttccggtaaaattctgcgggaacaaatttgaccggtcttccgtccagcttcactgtcaatccctcccgcgcaagttcgttcagatctctgctcacattgctccggtcgagtcccagcctttctgcaatatagcctgagtccgcctccggctcaaagccgctgtctgtctgtattcttgcatattctgataaatactgaaatattttctccttccggttcatacgctctctccctgctctctctttggcgtcctggttttcttatgactattgtaccgaatgaagtacataaactcaagaaagggcttcttccattatcttccgtcagtcaaatactataattccttttacatattcttcaggattattttcaagcagttcaaatccccgggaaatctcctcaaacggaattctgtgggtgatcagccggtctgtggggaagattccttttttgtaggcactcactgctttttccagtgtgtccatatagtcttcgcagtaccacggatgtaccacatggaggatcggagagcggtacatcatatgataggccattttctgcgtaaacacttcatttctcgtatacatagacgggagaaggatctttgctcttccgctgatcctggaaatagacagggcagaagccaatcctctgagacttcctgtgatttccacgatgacgtcaaatccctttcctcttgtgatcttcatcatggcttcctctaaagactcttttgccggattcaccgtatggtccgctccatattctcctgccacagccagccgtccgtccaccaaatcaacggccgtcagacttccaagacggtcattcttcagtccggcgatggtcaaaaggcccatgaacccgcatccgatcaccgccacatggtcaccgaatgccggtttagcagcctgaacgatatttgccacacacatcatcggctctccaagacaacattcaaaaggtttatccatttccggcactctgaggattctctcctcctccctgatgatcttgtgtgtcgccatacactctgatgtcactccagtcacccggtcgcccggtttaaattttgtcacagcatttcccacggcttccactacagcggtcggttcgtggccgattcccataggataatgaggtttaaccacatcttcatatccaagaggatttcttcccatggcgctggtgcccatatatgccggaatgtcagaatgacaaagtcccgcgctgaccattttgagcagtatttcgtctgatttcagctccggcaggtcttcttcaaaaaactcaaatgtttttggtccggtcagctttgcaatcctgcgtttcatctctccacccgctttctctctatgacttttctgactttctgagcgatatcatctgccgtgaggccaaaccgttttttcagatactccatatctcccacttcaccgaactcatcttttattcccacggcctccaccgggacaggatttgtctttgccagcacctcacaaaccgcaccatacagtcctccgtggatattgtggttttccgccgtcacgacagccttcgtctcctgtgcacagcgcactgtcagtccacagtccagcggtttaatcgtaaacatatccacgactcttacggaaataccctccttctctaatatgtgggctgctttcagcgcttctgccaccatgatgccgctggcgattacagatgcatccgttccgtccttcacgatatttccttttccgatttcaaactcagaaccttgttcataaatcctgggtacattttttctcgcacagcgtatgtagtacattcctttcttctctgccagctgctttaccagatcttttaacatcacatgatccgtcggctcaacaatggtcatcccgggaaatgcccttaaaactgccacatcttcaaaaggcatgtgagttccgccattgtatgccgccatgatccccggatcagatcccacaagttttacattggcacccgcataacatccggaaataaaaatctgatcattggcccttctggaaataaacggcgcaaaggaatgggcaaacgggattttcccggcaaaagacaggccgcaggcaacccctgtcatgtttgcttcctgaattccgcagtcaatgatctgtcccggaacttcctctgccagttcattcatctggtttcccatcagacagaatcccaggtccgcctccagctccacaatgtcccggttttctttcatcagttccatcatggtctctgagtagatctccgccatggatctctcgccgttttcatgtgtattggatattactacgctcatattctccctccttacgccattaaggcttcgatcgcttccttggcctgctctccggtcacattgatatgatgattccatatggtttccgcaaacttacagccttttcctttcagtgtatcgagaatcaccgccgtaggccgctcctgttcctgtatggcctggccaaccgcatcatcaatggctctgcagtcatgtccgtttacccggactgtatgccagccgaaacttttgaatttctcttcaaaatcctccatgtcacagattttttctgtgtcattgtccagctgttttttattgttatccacaaacagagtcaggttccccagacggttctgtgccgcaaacattgcagcctcccagttctgtccttcctggctctcgccgtcgccgatgatacagtagacccgttctttcctttcgtccagtttctttgccaaagccacgccgcaggctgctgagagcccctgtcccagagaaccggtcgtcacatcgatccccggtgtctttcccgcgtcgcagtggctcggcagccttgtgcccggctggttcagcgtatacagccactccttcgggaagaatccctttaatgccagtgccgcatacaccgccggccctgcatgtcctttggaacataccagccagtccctctcttcaaaggaagggtcctcaggacaaaccttcatccgtttcccgtataacacactcagcagatcgcagatactcatagcccctcccatgtgtccgaaccctctctctgccatctgccgtattgtccagatcctgatttcctgcgcaaaatcagtaagttctcttaactcctgctctgttaccatacacgtacctcctttttgttccgttgatatgacaaaatagaaagcaaaaaccatgccaacatagtgtgttaatgggaaaatctctctgtaagtggtatcattataaaaattgagcaaaaaacaacttaactctcattacataagttgttttttgctcaattttttaacttctattcctatgaataaaggtgctttaaagccttattttatcaggtttttttcaaaattatttgctgcaggaaaaatgctcttgttcagcatcatatggaataccgctttataatgttctttttgtatcgctgttataatctgtatatcttgaaaattctcaggaatctcttcgacaatcctatctatttctcttacatccaaatgctttacaaaccttaataatgcagctgtacagtcaggattttcagcgctttcgatatactgaaatggatgaatatttttatcgtttttatctgtaaaaaatgaaacaccggtaccaagggcatcctgatagatatctctttcatttgcaattctcctttctgccacagaaggattgcgtttattaaacagacaatttccattgtcataaacaggtgccaattttcctgttccgtctgcattaataaaaatgccccagtttccgttattgcggtcattattccgaataaaggcatctgcaataaacatatcccaaaatctttctttcaccccaggagtcttttgaaaaaccggcgctgtggaaataacattcagtacatccatcaaagcttctccctgctggcctgatgaactatgcaccaattctatctctgtgtctgtcaatgagttttttatctgtccatattctaccagcctgtgtaaaggatcaaaatctttacatgcaacaactaatttgttatcccttattcctaacattgtctcatgcacaggaatccctaatgattggtaaatctgagaaccaatatattcacttaatggactggctgtataagatggaaagtgggcgttctttttttgtcttcccataaaatcctttgtactctctgggaactttatcatccatcgttctccgtcaattataatcgcatatttagatccacttctccctccataataagtagaaaaatcacgctcgtatttatttagatcttttatatcaatcattctttccctttccatatccttttgtccaattttttgcagccattataccagagcttctatactgtatagtatgccacgtaaatacgtggttatcaattcatttttctctccccaatcatcagcgcaggcagtatataaattgccgacataaagatccctctcatgacaaagatcatatcgtgcatatgactttccaggttctccagataataattcgggaacattcccgccagcacgctggtctcgtcgagcatcagcacagaagatatgactgcttccagcagaaggaacaaaaggctcatccccagtcccaatcccccgtttttaaaagaaaagcacaaaagcccgaagactgccgcatagacactcagcagcaggaattcaaagagcagttccaggatgaacatccacacatccggctttccaagcccaaagttaagcgtcagccctatgacatagagcgctgtctgaaacagcaaaagccttgccatcgtattttctacttttatgtatttccagaaaaatgaggacggctccctccgcctcatcacatctgctgtataaactgccacgcatagttccaggattccggaggacatggaggtgagatggaccgcattgatcccttttggaagaaatccgtaaagagtttccagactcagctggtatccctttggagaaggcccggtgctcaggtacgagagcactgccatgtccatgaccgcatagcaggacagagccgtgacacaggccacgagaatcttcccgctgtgatattgaaaatctcttccctccgaatagactttaaaacaggccacaaggataccggccagtgccgcacacggtgccgcgatggaaaaattgatttcctgaaggaatagagatacgaactcatcttccatcatcatcttgactgctgtgtagacaaggtatccggcgcagatatcgtttaggaccggaaactcttccatccactctgcaatggttccgctgaaccagagaagcagcggcacacaaaatgccaggccgccgaagatcagcagaaattctctcatatgcagaccgccgccgtccgcagacacgactccgaggatagccagcacgttgtcaaaactcatactcacatctgctgccacgatcgaaatgattgcaaaccagaagctgtccttccgtcctgtctgttcacgcttttcacttcccgttccgctttccatcatcatcgtgaaagtgacatataaaagcatcacacctcccagtattctgatgtgaagccatggaatcctgaacaaaaatccgatgatccccacaaagatcatcttaagaaagatagacagccagacgcccagatctcgggccgctttggcccggcgctttgaaagccccctggttgccatggcgatgacgccgatattatccagagacacgacaaggttgataaaaataatctgaagaagcgtacccaaaaggccttccccctgtgcaaactttattatttaccatatatatgcaaaaagccgcccattcatttctgaatgtacggcttttttaactattaatctcttactttgatgtgtgtttcccttaactgaagctctgacacttctcccggagccccgcacatgagatcctgtgcagttccgctcatagggaaggcgattacttcgcggatattttcttcatttctaaggagcatgatcatacggtcgatacccggcgccattcccgcatgaggcggtgcgccgaactggaacgcatgatataacgctccgaacttttcttttaatgtctcttcgtcgtatcctgcgatttcaaatgccttgaccatgacgtccagatcatggtttctcaccgcaccggaggaaagttccactccgttgcagacgatatcgtactggtatgcgaggatatccagaggatctttttcgttcagcgcttccagtcctccctgcggcatggagaacggattgtgtgtaaaggtcacctgacctgtctcctcgtctgtctcatacatcgggaaatcgttgatgtagcagaaacgataggcatttttttcacagagatccaggcgcgcggcaagttcgtccctgatctgtcccgcaaacagacaggcaggtttttcactggctgcgataaagaagatcacgtccccagcctcaagatgtgctttttcggcaagctcactcttcatatcttccgggataaatttgtcgatcggtcccttgtaagacatatcctcttttacttccaggtatccgagtccggccatgccgatggactgtgcaaatttaagaagcttttcatggaatccttttgagagatttgcgtgaactttcacggcccttaccgtcttgtcatgaaacggcttgaaggtacatctctggaaaaagtctgtcacgtccacgatcctcaaaggatttcttaaatccggtttgtccgttccgaattccagcattgcctgctgataactgatcaccgggaatggcgtgtctgtcacaacagacccttccggcgcaaacttcttaaaagtctctgccagcacttcctcaccgattttaaagacatcttcctgtgtggcaaaactcatttcaaagtccagctgataaaactctcccggagaacggtcggcgcgggcgtcctcatctctgaaacaaggcgctacctgatagtatttgtcgatgccggataccatcaaaagctgtttgtactgctgcggagcctgagggagggcataaaacttccctttgtattttctggacggcacgatatagtctctcgccccttccggtgaagatgcgcagaggatcggtgtctgaatctccataaatccaaggtcatccatctttcttctcaggaaactgatgacttcggagcggaatttgatattgtcctttactttgcggtttctcaaatccaaataccgatattttaagcggacatcctcacggatctctttggaacctgatacttcaaacggaaggtcagtatataccttgccgagcactgtaatcttatgggcttccagttcgatagttcccgtaggaattttcggattgtaagtctcttcgtccctgtgctcaatgaccccttcgatggaaaggcattcttcttttctcacttcatttaaaagatctgcgtctcttaacacgacctgcatgacgccgtacatatctcttaaatcaataaatgaaactccgccgtggtctcggatattttccacccacccggcaatctttaactgggacccgatatcactctcagaaatcttatccatagtcttgctgcggtacatatctgacatttctttttctccttttactttcatcgtgataaacttttttgtaataaaaaaagtcgtctatcctaaaaaatcattcaggacggacaactgtacaagttccgcggtaccacctgatttgctgccctgcagcctctctggtatgctgaataacgcacagcctgcggcgcacctactaatccttaggatgttcagattgcagctcctgagtgttcttcacataaattcactctgcggagttcccactgtctcccgctcactggaagcgataatttatgctacttttctcaatctacgctttttggatcattatagttcagttttgtctgtcttgtcaatttatttttctctttttctatatttcctctcttgtgattgactgatttacacaaaaaatactataataataaagtactatatagtaaatccgcctgacaggaatatacatatgaattctaataattttacttcggaaacgagtatttatatcattgacgatcattacaggatcgtgcatttcaacagggagcttcagcaggtctttccacagatctgctgcggcgatatatgctatgaagtcttctgcggggagaaagcaccgtgcggcggctgtcctcttcatgtatctgagaatgaaagcacgctcttttataataagaagatccatcagtggatcgatgtgagcaccggcacgatagactggccggggaaagggctctgtcacgttgtcctgtccaaagccatctatgagggcaataaaaatttattttataacctcacgaatctctctgcctatgacgaattatttgaactgaatctcacaaaagattccttcaaagttttatttcatctttctgacaaatatattattccctcagaagagggatctttatccacgatgatggcagaagttatatcccggaaattagttcatcccgatgatattgcggactatcttgacttctggaatctggatacgatcatggaacggctcagcagcgcgtctccgtctccgtttcttttaggccagttccggaaagcaaaaaaagacggcagctactgctgggttgcccagactgccgtggctgtccgccagagcagagatgatgaccagatcattatgtgttttgttcaggacattcatgagcagaaggaaaaaagcctggaaatccaggaacataagccgcttccttccacttctattgaccctctgacaggactttaccgaaaaaatatattcgttcagaaagcagtccggctgctgcagacatcaggaacacatgagcactgtctcatggtcattgacatagaacatttcaagcttttcaatgaatggtacggacaggaggcgggtgaccagtttctcatagacatcggcctccatctgaaaaaggcacaggaggagcacgaagggatcgccggctatatgggagacgatgatttctgtattattctccccaacgatcaggcagttatttcttctctccagcaaaagatcatgggttatatcaggcactatcagggcaatgtagggtttctgcctgcctttggtttatatatgatcgaagactgcggcgtagccattcagaccatgtatgaccgtgcagccattgccatgtcttctgtcaaaggaaattacacaaagaggtcctgtatttatgacagcggcatgatgcagaaaatgaagaataaccatattctcctgtcggaagtccagcatgccctggaacaggaagaatttacgttttatgctcagccgaagtgcaacatggctaccggaaagatcatcggtctggaatctctggtccgctggaatcacccaaaacgcggcatgatatctccgggagaatttatcccgcttctggaaagcaacggatttattacaaatctggatctttatgtgtgggacagggtgtgccgttcggtcagagactggattgaccggggccacagagccattccgatctctgtcaatgtttccagggtagatgtttattcactggacatcgtacagacttttaaggatcttacagaaaaataccgtctggaaccgcatctgatcgagatcgaaattacagagagcgcttatacggaagaatacgagctcatcaacgatacgattgaaaaactcagagcctctggatttactgtcctgatggatgacttcggaagcggttactcttccctgaacatgctgaaagacgtcaacgtagatgtcttaaaaattgatatgaaatttttggagatggatgaacagagcgccgaaaaaggatacggcattttggaagccattatcagcatggcccgtttcatgggtatgaaaatcatagccgaaggcgttgagacaaaggaacagatggattatcttttaaatatgggctgtacctatggacaggggtactacttctaccatcctatgcccatcagcgtgtttgagcctttactggccaataagaacaatctcgatctcagaggcatcaaggcacgccagctggaacgtctccatatcaaagagctgctaaatgagaatattgtcagtgaggcaatgctgaataatattatgggcggtgtagctttttataaaatccatggacgtgagatcgaacttgtgcgctgtaatgaacaatattttaaagttacgggttccaatgccgttgatctggaagaacagcgcagaatcatcctggaaaatatttatgaagaagatcatcagacagtctttgatttattcgacagcgctgaccgcagtattttaaacggagccgaagcggacgtccggcgccttaaagatgacgggagcaccatctggattcatatgcatgtgtaccttctgaagaaacagggaggggataaactctactatggttccatcagtgacgtgactgagcagaaacagagagaacagaggctgaatgcatcccagcgggctctgtctgctgttgtccatatctcggaaaaagatccgtcctttatgaaacttacggaagaaaaccgcaggactgctgcctccatcttcgcccagatgtcgccgggaggaatgatcggcggctactgtgaagacggtttccctctctatttcgccaaccatgaaatggtccggcttttgggctacggttcctttgaagaattcgagcaggccatagacggcagagtcatcaataccattcatccggatgacagggaacaggtggcaaaagatatcggtccggaatactacgccgggcttgagtatacgactacataccggatgcccaaaaaagacggttcctggttctggtccctggacaaaggaaaggtcatagaagcagaagacggccgcttggctatcgtcagtgcctgcactgatatttctgaaccgatgagcgtccagcagcagctggcggagcgcaatgccatactgatgcggaaatcccaggagctggcattcctgaacaatgatatgcccggaggttatcaccggtgtgaagacactccggattatgattttctctatataagtgaccgcttcctccagatctttggctttaccagacaggagataaaggaccgcttcggcaataagtttatgaacatggtccaccctgacgacagacacctggtgtcagccggagtagaagaacttgagcggcaggatgtgatagtcaattttgaataccgtatgctcagcaaaaacggatacatctgggtcatagatcaaagcaggtatatggagtatcagggccggcagtttttacaggggatcatcacggacattacagagactgtcaatctccgaaaccgaatgagccatctgtttgtccatcttccggaaagtattttcctgcttcgaataagagaaggcagaattgaattcaggctgctctctgagggcttttttgcggaatatggctatacagcagaatcattggaccagtatgtcagaacccgtttttacaacgataccgtgcatcctgaaaatctaagacagataagacaggaccttttaaaagccatgaaaaaaaattcagaatttaaggcttctgtcaacatacattttcctcagaaagaatcattcgctatatcactggaggccagcccgattaacggaagtacagacagtttttcttacatgtgcatctgcagaaaaacagaatctttatgatcatccaaaagagctgccgggaccggcagctcaattaaatgtgaaacagaatcatttttggcagtctttgatatgcagctgatagtcacttgtcattttcccctgctcatacatctctattttataatccaggcgttccagtgtttcctgcatatcctgcattttctgtaccagacgttttctctgttcaatgagaatcgttttccgggcatccatcgtttcgtcaccctgacgaaacagcgctacgtattcgatcagtgcctcgatctgcaccccggctttccgcatgcacttcatcagttccacccactggcaggatgcctggtcatagtcccggatgccgttcggcttcctcgggacagcgggtatcagcccaatcctttcataatatctcagcgtatctgcggttatgtcatacttcttactcacttctgcgatcgtcaaaatacattcctccattcaattcaaagtcctggaaaatgacagcggcagttccatcccattgtcttccaaaagtgtttgatcccttaatatttctcccgtaggtccgtctgctgcaagtcttccgtctgcgatcaggatagtcctctcacacgtatcatagatgaaatccaggtcatgggacgcaatgattttcgtcccggaaagtccgttcaggagatgaatcaggctgcgcctgtttttcgggtccagagccgccgacggctcatccataaggatcacctccggctccatggacaggattgatgcgatggatgccctttttttctctcctccggacagccggtagatatgcctgtctttcatctgctccatatggacactctccagtgctctcatcgtcctctctcttgtttcctcctcagagagcccgtaattgcgtggcgcaaaagccacatcctcgtataccgtagacataaaaagctggctttccgagtcctgaaatacatatcccgtccttcttcggatatccgccagagaatctttctccacactgaccccgccgattctcatatctccttcataatctgtcagaagccctaccatgagtttgagcagtgtagacttccctgctccgttagccccgatcaggccgatgcgctctccctccgctgccgtaaagcttaaatcggaaagcacattttttctgcctgatgaggctcttttttcataagaaaaagtgagaccgtttacttctattttgttcatacttcctccgtattttattttagcaggcttccggcaagtttaaaaacagaaacataccgcagcaagacaacgatacccagccagcctgccagataaacggcactgcccgggtccattttctgtttctttgacagatgaaaacttccgtcaaagccccggagcagcatgctctcatagaccgtctgggcccggtcgatgcttcttaacatcagctgtcccagcagggtcccccatgcccggtaatggattcccttctgagccggtgctctcaatgagtacgcctgggagatccgttcggcttctttcagcagcacgatcacataccgatagatcagaagcaccatggtcaccaggatcttcggcacatgcaggagacgcagagcataacagatgctctccatggacgttgtcaggatcagcaggtaagacgccagcaccgcaaaaactcctttgagcatcagtgtcgccatggagatcatgccgccggttaccggtataggtccggcccggaagagtacgccccggtcaaaaaacggattcgcgatccccaccgcacagacgagcagaagaaccggacctaattttcttatgcttctgaccacagaaatgtttcctgcccgcatgattactgcgggatacaggatcatacaaaaggttccgctcaggtcacaggccggaaatgacatggtaaaagcgatataccagaccgtcacgagaagcttgctcagaggatgaatcctgttgatttgcccctctctttgggccatggcatccagatggtgtatttcatgtactgcctcattgattctgctcatgtttccctttcttcctaaacaggccgaacaggtaacagacggctgtgcataacacgatcaccgcgattcctccgaagatgcctgacagagaagttccaagcatcgtctcccgatccgggatagaataatccggcaggagggaggtcaggccctgaatcctttcggccgcagcgtgaatcggaccggaagccgcaagctccgcggatcctgtgattttttgtatagaccattcaagcccgtccggatttgaggatgcagccagggataatgcgcctccgatcagtacaaatgcgcctgcaagtgcaagcagcacttttcggaaagagagcttcggcttctttgcgcctgccacagatttcccggagtctccggtccagataagctccggcctggcctcgtacaggaaacagagcaccgcagcagtgatcagtccttccaccagtccgatggccagatggatcggctgcatagcagctgcaaacactccaaaaggcagctctgtaatgcccgaagcaagtgtctctgctgtcacggaaagtgctcccagctgtaaggtaaggatacatccgataacggatgcatatgtaattttccttttatccggtccgtttttcatgaaccgcctccagagaagcccggctcctataaaacagccgtaaaacgccatgttccaaatgttgcatccaagtgcgagaagccctccgtccgcaaaaagaaggcactggatcagcagtaccccgatcatggtcaggaatcccgcaaatggtcccagtactgccgacacgagcattcctccgcacaggtgcccggaagaacctgtgcccgggatcgtaaaattgatcatctgtcctgcgaacacaaaggctcccatgacccccatcagcggaacttttttcgggtcatcttcctcctgtactttttttaccgcccatcctgctgccgccgcagaacaggcatacatggtgcctgccaccgcaggggccacaagcgcatctgccatatgcatatcctatttctcctttccctgtttcaagtgagtgtccatgctgccggacctgaatccctccagatccaccgtaatgtatgtaaagcctatttctttcagccgctttaccgcagccgctctgtttttgaccagaccgggaagatctttctcgtccacttcgatcctcgccgtatctccgtgaatacggacacgaacattgtaaaagcccaatgttctcagaaacttctccccttcctctgccatcttcattttctcccaagacagtctggtcccatagggaaatctcgtggcaagacagggacttgccggccgctctgccacagaaatcccatattccgatgccatcctgcggatatcggctttggtcatcccggcctgcacaagaggactgagaattcccagctcttttactgcccggattcccggacggtaggcgttcaggtcatccgcattggttccttccagtaccgtctgtatccccaacgctttcgccgatttcagcagttctgtatacagatatctcttgcacagataacacctgttttccggattgtccatgatccccgcatgggaaagttcatccacatgaatgacacggtgaacggctcccgcttccccggcaactctctccgcaattttggcatccccagacgggtgaagttttgtcaccatcgtaaatgccgccacctttttcccggttttctctgccgcaaggcacagaagctttaagagcaggctgctgtccactcctccggaaaaagcaagcgccacatcttcctttacaaagcctctgactgcctcttttaaatttgcgcagtgttcctcatatctgtccatagcattcctctgcgatcctttggtaggtttcctggaaagaaagcccgttctttctgcacagttccctgacactctcatactccggataggctctcattccgttttccataaaacacaccttgatccgggcttcccccagagaagtcttcactgttttcacctgccgtttcagtacacttcgttccatcttctgtctgcggatgccgatggtcgtcgtctcccggaaaatgatcccctcaagtttctctatgtcttcctccttgcagatgacattgagctgataggccggtctgttcttcttcataaatacgggtgtatagtggacatctcttgcccctgccttcatcagccgttccatcacgtatcccagcgcttccccggtacagtcgtcaatattgctctccagcttgtatatataatcgccggcgcttgcgttttctgtttcccggatcagcatggcccgcagcaggctcggccgttcatactctctctttccggccccgatcccggttttctcgatcacaaaccgctccggcagccgggcggaagtccggatggccgctgcgatagcggcgccggtcggagtgaccagttctccctgcacatccgtcatgtgcaggggaatggagtatttagacgtgacggcggtaactgccggaaccgggaccgggatcacaccgtgctggcagcgcacagacccgcttccctcacagagcacaggaataatgaccttgtcaatctgaaggttgtcgaggcagacagctgctgccgtaatatccacgatagagtccacggctcccacctcatgaaaatggaccttttctatactggtcccgtgagccttggcctccgcctctgcgagtatctcaaaaattctcaccgccttctctcttgcaccgtccgtgatctgtgccctgcaaaggatctcaagaatttctgcgagccccctgtgttcgtggtcatgagaatgatgtccgtgatctccgtgagaatggtcgtggctgtgtccgtgaagatattccatatcgtggtcgtggttttcatgttggcgatccaggatcacgtgaaagtcacacgcgtccagtcctgccttagatactcttgtcacctctgtccgaaatccctttataggaagactttcaagagcctctgaaaggaccttttcatcggccccgagatccagcagagccgctgtcatcatgtcgccgctgatcccggaatagcattctaaataaagtgtctgattcatgatcgttcccccagtctgttgatctgtgatgccatgtagccggcaccgtatccattgtcaatatttacaaccgcaatgccgttggcacatgagttaatcatcgtgagcagagccgaaatgccgttcagactggccccgtagcccacagaggtaggcaccgcgatcaccggcttgtcaacaagtccaccgatgacacttgccagagcgccctccattcctgccgccgcaacgacacagttggcactctgaatcacatccagccgggacaagagccggtgaaggccgctgactcccacatcatagatgcggtccacgtgattgccgaagaactccgctgtctgggccgcctcctcggccacagaaatatccgccgtgcctcctgtgcatacggcaatctttccaatcttctttttcccgggcttttcaatcttcataatgcgggatactgcatcgtatgtaagttccggaagttcctgccggacaagttcatactgtgcccgggaagctctcgttccgaatacttccccgttctgttcccataatctctgaaaaatactgaccagatggtcatcagctttaccgctgcaaaagacaacctcggcagctccgttccttaattttctgtgggtatccagtttggcataccccatatcctcaaagggctccctgcggaaaaatgcttctgcctccccaacggacatttctccccggctgactttttctaatacttcatgtgcttccatctctgcgcactccttacttttttatttgaaggccgcggcatcttcctgccggccactgtgtgctcctgaatttactatatcacctggagctcactccaagtcaatattttttacaatcttccttaattggtccaaccaattttatcatattttttcaccagtgggaagactggtgaaaaaatcaactctcttattcttcttttgcccatccgtatgaatagcggactgcccgtttccatccggatacttttttctctctttcttcctcactgatctgaggttcaaagacacagtcgatctccatgttctcggacagcttctctttgctatcccaatagccgactgcaaggcctgccaggtatgccgctcccatagctgtcgtctccacacaggccggacggtgtaccggggcaccgctgatatctgcctgcatctgcattaaaagattgttctggctggcgcctccgtctaccttgagagaacttaaatgaatgcctccgtcggcctccatagccttcagcacatcattgacctgaaatgcaatagactctaatgtcgccctaataatgtggcacttattgactccgcgggtaatgccgaggatcgttcccctggcatactggtcccagtgaggagcacccagtcccgtaaacgccggcactacataacagccgttgctgtccttcactttttgggccatatactcagaatcctgggaagaatcgatgagttttaactcatccctcagccactggatggcagctcccgccacaaaaatagatccttccagcgcatagtccaccttaccgtccagtccccatgcgatggttgtcaggagtccgtgctgggaatttacaggcatccggcctgtattcatgagaaggaatcctcccgtgccatatgtattcttggcttcgcccgccttaaagcaggtctgtccgaacagagccgcctgctggtctcccgccgcgcccgcgataggaaccgcaccgccgaaatatgacgggtctgcctcaccgtatatctcacttgactggacaggtttcggaagcatcgcttccgggatgtcaagaatctcaaggatctccttatcccatgtgagatctttgatattaaacagcatggttctggacgcattggaataatccgtcacatggacttttccttttgtgagtttccagatcagccatgtctccacggttccaaagagaatctctcccttttgcgccctctcccttgctccttccacgtggtccagaatccacttgaccttcgtcccggaaaaataggcatcgatgatcaaaccggtcttatcccgtatcttttcttccagtccctgttctttcagggaatcacagagctgtgaggtcctgcggcactgccacacaatggcattgtagatcggctcccctgtctccttgtcccaaaggatcgtagtttccctctggttggtgatgccgatgcctgcaatctgttccgccgtgacaccgatcttctgcatggcctccaccgccactccaagctgcgtagaccagatctcgtccgcatcatgctccacccatcccggattcggaaatatctgagtgaattccttctgagccacactgcagatcttgccttctctgttgaacaggatacaccggttgctcgttgttcccgcatccagtgccataatgtatctctccatattgccctcctagatctccgttaattctctgtgctcccacacgttatgtctgatttattatagcatattgcacaaatatatccaacagaacagcaattatttataaacttttcatccatgcagaaggacacagacaaatcctcttcattagattacgaccggtcaaacactgccagggatgttacccctcctatgatcagggcgaatcccagaacatccacaccgacaaagacctctcccagcagcagcgcggacatgactgccgccaccagcggttccacacacgcaaacatactggctctcacgggtcccagcagacggacgccttccagataacatccaaacggaatcaccgttccgaagatgataacggccagtgccaaaaggaccgttgtcatatcccatataccgggtacatgaaaaaatcccgtcacaggtatcataagaagtccccctataaacatcccccatcccacggtctccatggacccaaactcattgaggagcttttccggctgaatgttatagacagccagagccacggcagccgcaagtccccagaacaaagccctgcctgtgacagccaggctgcccggatctccgtgagtcgccagcaggaaaacaccggctataacgcagactaaaacaatcacttccaggcgcttcggctttctcttttccactgccagacagaacagcatgatcagcgccggggcaatgtactggagcaccgtggctgtccccgggttagaatactggattgcaagaaaataagacatctggcaggctgtcatcccaaacagacaaaataccagctggctgactgccgtccgtttctttttccagacacggaatatatcccccttcttctggactgccgccagcataagcataagcagtcctgctgacaaaagcctcagcgtcacaagccagacggccgtgagctgcttttcgtcaaacagatatttcccgataatcccggaaatcccccagaagattccgcccagcatcgtaaagattacaccttttgtattttggttcataggtttcttaaatcctttcttttgtagttcagtttattataatataaaacagtgttttgaggaatctgtttttacagtataatgaagatagaaggatattgtctcagcacgcaaaggagctcgcctatgtccacaaatatttttgattatctggcctggaggggagatttaagttttcaggaatgtaggatcaatgaggttgacagcctgatcctgtcctgtctttcctacatccgcttccctggcattgtccccggtatctcggaatccggctcggtgacaatcaaggaggcatccgatgcatttttctctcaggacagagaaaaccgccgtaccagaacgaaagaagatgaaagactgcttagaatgctcggagagagcagacgctttgggccgctgagactttcacgttatgccgaccgtttaagccgggaacaggaaaaacagttttccgccgttacgattctgtttgaggatcacagcgccttttttgcatttcgcggggcagacagcacacttgtcggttggaaagaagactttaacatggcatttatgcctgtgattcccgcccagaaggaagccttggagtatttgatccggggagcagagcagaccggcggtccacttttatgcggaggacactcaaaaggaggaaatctggctgtcttcgcgacgtctgcctgcccaaaagccatgcagaggcgcatacagacagtctacaatcatgacggtccgggctttgaaaaagaaatgttaaaaagcgaaggctatctttctgtatcagaccgcatccataccttccttccccagtcttcggtcgtaggcatgcttctggaccatgaagacgattatactgtcattcacagcacacagaccggacttttacagcacgatccatattcctgggaggtcatgggacctgagtttatccgggtaaagtcagtcagcacctcctccgaatttattgaccgcacattaaaaaactggctatccggcctcagcagctccgaacgaaaagattttttcaacagcctttatcagattttctcagccacagatgcggagacacttcaggacctgccggtctgctggatcaaaaattttcgtaaggtttccaaacgtctgctggatgtttctccggaaaaccgccgcatgctccaccgcacttttttcaggcttctggatgctgggaaagaagcattgctgaaggagctttaaaaggactgccagttcggcagggttcaagaaatccagaagtttgttgagggcgctgtccatgttcttcttcggtttccctcctttttcatgacagaaaagcaggaagtcctttcggatctcctgctcattagtactactgtgaaagcagcgattatcacgttgttttatgttttatacaaactggaatttgtgactactttgaattttgtctcttaattatattgaataagcttgataatataaggctgcctaatgcaatacctaaatatatgttgtttctttcagctgaaaaaaggcataaacaaataaatattgcagcggatagtaacaaacctacacttgctattgtcagtaatttgcaaatgatttttttatccatttttatctcctgtcattttaataattcccatttgtaatgttttctcactttcaaaatcataccataccagatgtaaaaattctatgtgatgatacgctcaatttaccgcaagtaatttttcgtagatttctttatctaagtctttgtatacattaaagataactctctcaatccttgtatccacagcgagaacatctttgactgtcttaatcgcaatctcggctgcctcccggtttggaaacataaaaacgccggttgagatacagcaaaaagcaatgctcttgcacccgtattcagatgcaagctgtaaacaggaacgatagcaggacgcgagctgctctttctgctgctcacttggatatcccgtttcgatgattgggccaacggtgtgaagtatatatttgcacggcaaattgtatgctggtgtaatcttcgcctgcccggcaggttcttcgcggccttgtttctgcataatctcattgcatttcagacgcagggcaataccggcttttgtatgcacgatattatcgatacaggagtgcaaagcccggaaacatccacacatctgactattcgctgcatttacaatcgcatcacagtttaacacggtaatatcaccctgccataatacaagacgcggatattgaggaaccacgggaagggatgccgcatcaacaactcctgctgcatcacgttcattggacaagtagttatcctgcacttccataaattcccggctgacagcctttggcggtctaacattcattaaactgcgcagcagtaatttttgctgctgcacatctgctggaataaccacatctttatactgaatatcctcatcaagaagtttctgaatcagatattttctttgctcgtcatgtgtcattttttctttctcccttcctgatgttttttttaccccatcagtgtaacccccatatccacttcttaattgcaagaattcttttttcgtcaatcaaatcaattttctgactcgaaacacaaatatctataagtttcccaatatccccgtcaatacaaatcgactgcgcttctatttccctcggagagtacgcttccccggaattgacgcagacatagactgcctttggattctccgcagtcagctgccagaaagggtactttataatccccggtgtattcattccgacgccaagttccaaaaacaggattcttttgtctctgttctcactgagaaatcttttataacgtccggccgcctcatgccacttctcatcttctatgaaatattcatctttcctaatgtttacttccatttctccgccgcagaccggacattttggtatcagggactttggtatcctgcagttcctctgcttccgtaccatggccctcacctgagtctcattatcgtagagcttcggatggcacgcttttttacactgaaacaggccgtaatctccctggacggcaaaaattctccgatcctcaaatccggacagccaaaactgatgatctacgttggttgtcagcacgaaataatttttatctctcactgcctgaaacagatctgtatatgcttttcctgagggcatatcatatcggtttaaataaatatgcctgctccagtaagcccacttttcttccggggaaggaaacggataaaaacctgcggaatacatatctctgagtccgtaccgctctatgaagtccttaaaattcttctcaaaccgttctccggaatacagcagtccggctgccgccgacatccctgcgcctgcgccaattacaatggcttctgcctgcgaaagcttttgttttaacaccctttgattttctgtccccatatttcatcccccttttgcacctttcattctcttcttttattctaatcggtcttccatactccgtaaaccacgcacaaaaaggtggcatggtatccaaaagatactatgccgccgccaggttacttattgtatttctaaatgggaagatataaaataaacatagcaaggaggaagtacacaatgtcaaaaaaacgaaacatcccggaatgtcctgtggaaatgacactgcagctgatcggtgacaaatggaaggtcttaatcatacgtgatcttttgaccggaacgaaacggttcagcgaactgatgcgctccgtgaccggaatcacgcagaaagtcctgaccagcaatctgcgctctatggaagccgacggactggtaaaccggaaagtctaccctcaggtccctccgaaagtagaatattctctcactgaaaccggcctgagcttaaaaccgatcctggactccatggtgcagtggggaaccgaatacagagacaaaatgcaccgcagtgagacctcatttctttaacaccacatctatgatcacgtattcacagtggcctcccgtgcggatcggatacccccatcccgccatgccggatgtcaccacggtctggaggttcccggtcttccggtaaccatagttgatctcattgattccaagaagctgcatcagctgcccggtcggccagatctgcccggcatgggtatgtccggacacctgaagatcgatgccctgcctgttattttccttcagatctccgggctggtgatccatcaggattctgaaacttttttccggtgcatctttcatgatctctttcagactcttccggtcccggtcaccggcatcctttctcccgatgatacagatatccttccctgtcttaaacacctcatcctccagcacacggactccggctttttctaacgtattcctgagataaccagaagtgtactccggcttttccctgtactgattggaatcatgattcccatatacataaaaacttccataagtactcttcatatatcccaaagctttggccgcccgttccatctcttctctctttgtatcctcatcgaagatatctccagtcaaaagaaccagatccggctcctgactctgtattttgccgcaccaattctccagatctttggcactcatcgtaacacccagatggatgtctgacatgagagctattctgagcgtttcctcctgctgtatcttaggagtcccgatcctgtaactggtcttcttaatctgctgcatattaatatatccgtaggaaaagacaaccgcaatgatgagaaaagacagtatcccgcttctgtaaatcagatcccatttcttgaaaacaaacggcgttctttttaagagaagattgatcagctcaaggaccagagagactcccacaagatgcaggaccgccactcctccccatccataggccggccatgctgaaaacacacaagccagtgccaaaaccgcactcagcactttcaccatgcgtacgtctctttttaagaaaaggcttaaaatcctgcggaagaaaatatataaataaatccctgccggtatgagaatcaggatcggcagtataaaaaataataagtacaatgcgaattctcctttggcttattgtgcgaatatttcagcggcttttttcatgttttcaatgatggacacttcaaacggacaccgattctcacaaataccgcatccaatgcactctgatgccttatgttccagaaccgcatagtgttctctcactgtttcaggaacatcatcctgagcctttgccagatttaaaaacttagtgacagaggccacctcaattcccttcggacaaggcgcgcagtggccgcagtacatacagtggcctttccagctgatattcggaaactcagccagggcacgggcgtaatccttctcatcttcgcctgcctcttcatacctcagactgtctgaaagttcttcggcagtgtgagccccagccaggacagatgctgcggcaggcctggtaagtgcatagtgaatgcattgactcggtgtcagcgctctgcctgcgggtgataattcctcactcagcagatcccctcctccgaaagctttcatgacggtaatgcccacaccctgtttactgcacatttcatacagctcctccctggccgggtccatattcacaagatcccctttataatttttgtcatcccataatgcctcacagttttccccggcgggctgcagatcatagcaaggattgatgctgaacataagaacctcgatctctctgctctttacagcttccatggcagcctccggattgtggctgctcagcccgatatggcgaatctttccctgagccttcagttctctggcatactgcatgaccgggccctcgtatacttccttccagtcttttaaggaatctacatagtgtatcatccctacttccaaagaatcggtacatagtctttgaagcatatcttcgaatccttccctgacttcatcaatctgtctggtgcgcttatattgtccgtccctccaaatcgtacagagatgcccctgaaggaaaaactcttctctccttcctttcagcatctttccgattcgatctctgagatccgaatcaggcgtatataggtctaaataatttattccttttttctgtgccagatttaagagttcttctgtttcatgttcgtcttttcctacaaatccctcacatccaagcccgatctcactgatctcaagccctgtattcccaagcatacgatatctcatattatttgtccctgacctttcttcatttcaatggttttctctatcatagcacttggagctcactcaaagtcaacaatttccgaaaaaaggagccctgaaactaatcaggactccttctgcatcattctctcttatttttccggcgctaaagtatcgagaagatattcttctgcctctttgcaccacacattgttgtttgccttgcagatctccgccagatgtgcaaacatttcgttttcttttcccagtttctcaaaatcttcgatggcagtcaactccatcttgatatgagggtaaatcagctttttgcctcccggaagcttcggcagattcaggatcgtatccggtgccgcgtcaatgcctccaatgtgtgtgaccatgtaagacggattgatctttccagccgcagacagttccagagactcgatcatatccgcaggcgctccccctgaagttccgcagatatgggttccttcatagtggacattgtagaaattatactttgccttgaagttgttgtccgtaggacctgcaaagaaattcaggcagccgtcgtttcctaaaaggtcgtctcccatctcgatgagggattctaccggtgcgaatacgaacacctcatcgtatccctttccgccgtttaattctttcagttcttctaccgcattttcttttcctgcggtgttcacatagatgagttccacgcccttagatgccgcatcctccggagtgatcagggattttgccctctcaagcctttcttcattgatatctgttacaacgatgcgctttgaattgtacggtccatttaatgcataatcaatggctccgattcccatcgggccagcacatcctaacagcgcaacacttccaccgtcctttaatcccattctgtgctcatacacatatggtgttgtgtggtaggtagcgtgaaatgccccgatgatacatgacatcggctctgccagagacgcatttgcaaaataatcaccgtcatatggaagtacgcatccaatgtcgatggaaaccttcggaatgatgcagtaagttgcatttcctccatagtattcgtagctgtatccggcagaatatccgctcggaagtcccatagccggctgaagtacgaatttctctcccggcttgaagcggtctttcagcttttctcccacttctacgatgtatccgccaaactcatggccggtaatcgtcgggtgctccggactcagatcatccggcactctcttgtgctccccgcctctcagtgccgccttataagttgaaaggcagatgctgtttgacacaacctttaccaaaagttcttcttccccgatttccggaagctccacttcttttacatatacctgatttttccctgccagaactgctgctgttgatttcatcctttatcctcctatataatctccgtctgcttctacttttaacatcagatccccgtccagagaagtctccaaaacccttctcacattcacgctgtcgctgtttatgtaccagtcctctgcctcttctctcgtaagtccgcccttcatctttcttccgatcagccgttcctttaacgtctcttcttctgagcggatcattattgtataatctgcggtatcctttaatgtcttccacggctcctcgtcaagaagcagccagttgccttcgatcagcacaatgtccttcgtgatcttttctacatcttccaccacatcgtggatgtttctgtcatatatgggccacagaatgtcctcttctttaatctttttcagcttgtcttccagttttttagtatcgtatgtttccgggcatcccttgactttcttcatcggcacttcttttcccatcacgaccgcattgtgggaattgatgtaatctgaatggtagtggaaaccgtccaggcctatagcctgtatctctgtcagatcttcatgctgcaaagccagatattccagaaacttggacaatgtcgtctttcccactgccggcggcgccgccagaaatacgatcagtctccggcccagttttttctgcatcccggtgagctttctcagcatgggcagaaaaatggtttctatggcttccccgctgtaaaccgtattgatctgaaatccgttgacatcaaacacatactctttccaatttttcatgatctacctcattaaattttgtttacgttgttttatgtccgtttatttttgttttatgggtaaattatatgatttcttcattgtcatgtcaatactttgccctaaattatgtttgtttctgttgttttgtttttgtttatgtggatttcaatttgaaatgaatctgagaatctgttatgataaatataacagcagaaaaggaggaaccgacatgggaaaacttctcgcaaaagaacggcagaaggaaatcattgaatatatcaacagcacgggaagtgcaaagatcggggagctcgcggacaagtttgaggtgacaaaagagacgatccggagggacctgacccatcttcaggagatcggagccatcgagcgcagccacggcggggctacactgatctccagtttccgtcccattcctatagagacacggatcagcgaaaacagcgccgtcaaatatgctctctgtgaaaaaggcctggaactgattccggaacagggcgtcatctatctggatgccggaagcaccatgcagtgcatggcaaagctcctgagccaaaagtcaggctatactatcgtcacaaattccatcaatacaacctatcatctgaataacggaaacaatgtgacgattctcaccggaggccagctcaatcccaacaatatgtccacagaaggatttcagacgaccaattttatcaacacaatcaaggtggatatcgcatttttaggcaccagcggctttgaacagcacaacggtcctgcggtctctgaatttacggacgcccagatcaagcaggcgatcattccccagtccaagatcattgttgtcatctccgacagttccaaggcacatatctgttctctggtacagtatgccaactggaaagatatcgactactttataaccgataaagatttgccgtccgccacttataagacactgagcgaattaacggaagttatcctggtatgacattttccacatgatttccgttcggctcttagaatgcttcactctaatcatgtaaaaaatagatatcctatttaccggaggaggagttctgtctcatctcagaaaaaccggcaccagaaaattaattccgctgccggtctgctattatttataaagtttttaacacttcgatgacttctcccgctgtctttgcttccagcagttttttcctgaaatctgctttgatcagatttcttgagagtgttgccagcgcctgcaggtgcaggttgctgtctgtatcggtggccgctatcatgaaaatcaggtgtgcttttgtcccgtcttcggctccgaaatcaaatcctttgtcagactttccgaaggccacccgtgcagtttttactgctgcggtcttggcatgcgggatcgcgatgtcaaatccgagtcctgtggaggactgctcttctcttgcatagatcgcttttttataagcttctttgtcggcgagcactccgccttcgtccaaaagggttaccatttcctcaataatctgatcttttgtctcaccctgtaagtcaagattcattgttgattcatcaaataattccataatttccataaaagttaccaacctttcttatacattatcgtgcgaagcacgccaagccccaagggcataaaatacgggatgccctttagggtaatctattatttctgctctacatcctttgcagtgagaacataaagtactgctcctactacagaacctgccaagatacataatacccatgttacagccggatgtactaacggaaggattaaaaatccgccatgaggtgcaggaacctgaactttcatcacgtaggaaagaatcgctgagatagaggaacctaccatcagaatcggcagtactctcacagggtcttttgccgcaaatggaatcgcaccttctgtgatgtgggtacatcccaatacatagtttacaagtcctgccgcacggtcagccttagtaaatttcttcggtgcgaaagtagctgcaagtgcgatgatgagcggaggtgtgatacatgccgcagatacacctgccataaagtagaagttaccctgagctaaaagtgttgttcctgttacatatgcagctttatttaccggaccacccatgtcaaatgcagacatacatccaacagcgagtcctaagatgattgggcttgagttctggagtcctgccaggaagtccatcattcccttgttgatgcctgaaaccggcccagcagtaacctgcatcagaatacctacaaccgccactgtaatgattggtataaagaaaatagattttaaaccttcaaactgtctaggcagtccttttaatgcatttacaacaaatttacaaaaatatcctgcaacgaaacctgcgataatggctccgataaatcctgaaccggtattattggcgatcataccgcctacaaaacctgcgatcataccagggcggtcaccgatggactgagcgataaatgccgccagcacaggaaccatcattcccatagaagtaccgccgactgtcttgatcgtcgcagcgattacattgtactgatctgagctcggatcgaaagaataaataccccataagaaagagattgctgtcaggacaccgccggctacaacaaacggaagcatatgggatacaccattcatcaggtgcttataaatctgatgtccgatggaatcttttccttcttctgcttttgtttctgtaccctctgcttttacctgtccgcctcttacggcaacatttccattaagcattttctgtactaattcttctgccttgctgattccgtctgcaaccggcacttcgatgaccggtttaccgttaaaacggtccatatctacatttttatcacaagctacgataattccgtcacattctgcaatgtcttcagcagtcagttcattctccacaccgacagctccgtttgtctcaaccttcatttcggcacccagcttttcggcagcttctttcaaagcttcctcagccatgtaagtgtgggcgatcccggttgggcatcctgtaacacctaatagttttttcatatcatttctccacctttcttattttgatgttgtgaaagtaagtatctactttggcaaaatcaccgagcgcgttgctctccgccacgtttgcccctgtggcagcagaacgcttcaatgcatcctcaacattttccggatgaccaagccaaaggcttaaaaagcttgccagtgcggcatctcccgcacacgccgagcttaataacttaaccggctgggaagatgaatagtaaacatcttctccgttgctgaaatatgctcccttgcttccgagcgtcagcagtacatttcttgctccctgttctttcaggaaggtaagaacatgaaggatatcttcctcgttcttaattttaattccgaagatttcttcgatctcttcgtcattgggtttgatcagcaaaggttcgtatttcaataagtcttttagtttcggagaactgatgtcgagtacaacatcgacgcccctctttttgcatatggataaaatgctttcataaaaactcggttcgattccgggcggaagactgccgctgatcaccagacagctcaaatcttcggccgtctcaaacagatgcagcatctcgtcctgctgatctctccccacgaaggacccgctgttgacaaatttgaattctccctctccatcattcaaaaatatattgatccttgtcgtgtcatcaacccagaccggtttcaccggaacctgtctcttttccagttcctctacaatatattttcccgaaaatcctccaaaaaatccggttaccgtggaatccaccccataatgtttcaatgtaagagtcacattgacaccttttccattgggtgtgtaaaccgtatcgaatgtacggtttaccttggcacgttccattccttttgtggatatgttcatatcgatggcaggatttgtagttaaggtataaatcatactgctcctccatagaatacaatttctttttacagttttcattatagacaagtattccatgaaaatcttttcatatcctgaaaataaactttaaattactgttttggaaataaaatttacaatagttactttttattggtaaaatatagaagaaactctcaatatcaaaaaagaaaagagacatccatggatatactttacaatttactgccaacagcaattttcataatttcttttttaatcaaagctattttatgtacagctctcatagcgacaactgtcctgctttttaaaatttataaaatattaaagtcaaaataagaataatatagagggaacagagaaatttatcgttttctctgttccctctatattttctaatccctgtgttcaatattttctaccaggaaatccaccaaaattctgcacatgatatacagcggaagcctggatgtcacctcatagtttctgatcgcaatatgggaatgtttatacccaagccatgtatagtccgaatactcaaacaattcactggagctgctgcagcacagagtgatcactttgcagccccgaagctttgcatttctcgccgactcgatcaattccttcgtctctccgttcagagataaaatgattacgacttcgtcttcctgaagattcttcgacataattctcataatctgcgggtcttccacatccaccacaaaaaagtccagtacctgaagcttcatgctcagttcctgtgccaccaggtgtgtcggtcccctggagaatatcaggaccctctttgcatccttcatggtgtgcagaatattcagcacatttggaatagacatgtgcttaatcacggaagtcgcctcaatcagagacttgttcatgatttcattcaagtctttcacttctgtattttccgtcttcgccgttaatttataccgaagctcgttaaacccattgatcccgcatttacggatggctctggacacagttgccggggaagaaaatgtttcaaatgcaatatctacgatggacagttctgagagcttgtcttcattgtcattaatataattgacaactcccaattcggtcttggaaagattttcggcaatcttgctgtttatctcaataatcataactcgtcctcctgtctgtgtgaaagatcttttttattatacatgattttcatccgttttcataacttgaaaagattttcacagctgatttttttataatgtaaatggttaaactaagacaaaaagcaggaaagctttaggaggatgaatatgagtaagatggtatcaaccagacatatgttattagatgcacaggaaaaacgatatgccgtgccggcatttaacattcacaacttagagacgatccaggtcgtggcagagacttctgcaaagcttggctctccgatcattctggcaggtactccgggcacattttcttatgcaaaccgtgattatcttcaggcgatcgtcgagacaactgctaaaaaatataatgttccggtggcacttcacctggaccaccacgaagaatttgacgccattaaagaatctattgacctgggcacaaaatctgtaatgattgatgcttccagccttccatatgaagaaaatatagaaaaagtaaaaaaagtcgtggcctatgctcatctccacgacgttaccgtagagggagagctcggacgtttaggcggacgcgaggatgatctcgtagtagacgaaaaagactccatgtacacaaatcctgcacaggctgccgactatgtggcccgcacaggcattgactctctggccgtagccatcggtactgcccacggtttatataaagaagaaccgaagcttgactttgaccgtctggcagagattagtgaggaagtatctgtaccgcttgtgctccacggcgcatccggtgtcccgggcgacgctgtgaggcgtgccattgagcttggaatctgtaaagtcaacattgctacagaattaaaaattccttattctcaggaactgagaaaaactttggttgaaaatcctgaagccaacgatccaaggatttatacaaaggaagcaaaagaagcaatggcagctgttgtagaagaaaaaatcaggatgtgcaacagccagaaccgttactaaattgaaataaagatattgatacccggccttatcatttacaggccgggtttttttaacattggggcgtctgattcctcttggccagatcgagagcgacccttttcccagtctctgtgacggcaagtcccgcctgacttgtctctttgagtcctccaggcatcatttccccgatttctcccatggcatcaattacctcgtcaaagggcactctcgtaagaattccggccatcgccatatctgaacaggccactgcgctgacggctcccgttacatttcttctgatacacggtatttccaccagtcctcccagaggatcacagaccagtccaagcagactcttcatggcaaatgctcctgccgataaaatctgttcattactccctccccggatggaggtcagtgccgccgcacacatcgcagacgcagtcccgacctccgcctgacagcctccctgtgcaccggagatactggctctgcgggctatgacctgaccggtcccggcggccatgaacagcccctcggtcatcgttctctccggtatcccataaaactgttcatatgtcagaaagactgccggcaccacgccgcaggctcctgccgtgggtgcggctacgatccgtttcatgcaggcgttggattctcccatcttcaatgctcttgtgacgaccatccccatgaagccgccggaaacggcttctccttcccggaccaaacgttgcatgtttgctccgtcaccgccggacaggccgctgaaagattttaaattttcctcatagtctgtatccgcctgtttcatggcttgatagcgctccctcatcttatccattgtctctttcatggaaacactgcgctctttcatatcttcctccatgaccgctttccaaagaggaatcttccccgcggctgctgccttttccatatctgccattgattcaaagcccatatttcttcacctcaatccatacccgccagactggcggctttttgaattcctttcatgttctcaatcattctcaccgtttcttccggtatctcctggtcacactccagcaccatgaccgcactgccgtttctctggtccctggaaagccgcatggacgcaatatttattcctgcatccgcaagcagagaggcagcagcggccacatgtccggggctgtcttcgttgtgaacgatcagtacagggatatccccggaaaaagtcgtggaaaggccatccatctgacagatctccactcttccgcccccgggagagctggccacaatttcaaggtttcttccgctttcccctgtcaggcgcagctttacactgtttggatgaacatctttcagatatgctctcccaaatgtccactccattccctgtttcctggccagctcaaaacttttcggaatcctcaggtcatcctgtgccattcccaaaagtcccgcgatgactgcccggtctgtgccgtgtccggtacctgtggccaaaaaggaaccgtgaaataagatctcagctttctggacctgctcgcccaaaagctttctcgaaatcaagccgattctgacagctcctgccgtatgggaactggacgggcctaccataaccggccccataatatcatataaattcataagtttttctccattatctccagtcaactctggaaaggcttccttccgacaatggagaaaaactatcgcagatggtgccttttgtctttaagcagcctgctccagcagttattacgtccattttccacatgattggagtaaggcattctaagagccgaacggaaatcatgtagaaaatgtcataagttatttaccactatttccgtcgcgcttttgaaatgcgctcctacaatagcggtaaataactttcgaaaagtggcaccttttttgacagaggcccttctccaacagacattacgtccattttccacatgattggagtgaggcattctaagagccgaacggaaatcatgtggaaaatgtcatgagtttttctccattgtctgttttttacttttcatcagtatgtttcgtttttccgattttatgaatcattcggctttgaacacagtaaaatatgctggacgaattgagtctctcgtgtagaataaaagaagaaagactttataatctgaaattgaaatcaaaaaccggagatgataccaaatggatttgaaaaaaacagctgaaaatataaatatccttgccgacttctgcggagtaagagacattgaggaactgaggcaaaacgcactgaaagaaaaatatggatttgaaaaagcggatgttctcattttattcggcgggagtattccagcgggctgtgacacggccgcagcaggctatttgaatggtgctgcccgcagactgatgatcgtcggcggagaaggacatacgacagagtttctgcgccaaaacattcacgatcaatgccctgaaattgagacgaacggaagaatggaagccgacatcatggaggaatatatttcacaaaaatatggaattcagaatattctgatcgaacggacctccacaaactgcggcaataatatcacgaacgcactggaagttcttaaaaacagccgcgttgaaacaaaaaatgtaatccttatgcaggatgccgcaatgcagcgccggatgtgggcaggttttgccaaacatacaccagacatcaccgccgttaattttgccgcataccgcaataaagttatcgtagagaatgaaaagctggaattttgcgacaaatctctatggggaatgtggagcatggaacagtacataacactccttatgggagaaatcccccgattgtccaacgatacaaatggatatggaccaaaaggctgtaactatatcgcagaagtagacatccctgacacggtccaaaacgcctttgtagaattaaaggatatctattctgaaaatatacggacagccaaccccaaatatgcatcccctaaaatataaagcatctgaaaaaagtctgtatctctcccttcatcgctcagggcatgatacagacttttcttattaaggccggcagacagccttgcatatagtgatttctctgttatatatctggtcaaacaattccttcaagtgttcaagatctgcactgtgggtgatcaggtcgtctactttcagactttgatcggcgatcctgtccgcagtgtactgccattcgttaaacggaaggtcattataataattgttccagactccggtaagccgtaattcttttctcagtatctggctgtggctgtcaagtttgagcaccgtgtcctgatgaggatttccaaggagcaccagcataccaaaaggctttaaacattccacggcctgattccatgccggagaacttccagtcccttcgatgaccgcatccgccatatgtcctccggtcatcgtccggatctgttccggtatctctccgtctgcaggacttatgacttccagccctttttccctggcaaactctgttttttcctcactgatctccaccaatacggcccgaatgccgaacattccgcaccagcgggccgtcaggatcccgatggggcctgccccgaaaatcactgccgtatccccgcctttgatctcccccttgcggatcgcatggagagccacacaggcaggctccacaagtgccagctgttctggggaaacccctgtattttcaggaaatacaaggtgtttccgagatggaagcagacagtactcggcaaagccgccgtctgttctggaacccaggtttttgtagctctcacactgagcatactggccgatccggcagctgggacattccatacacggaactaccggatagacagccccggttttaccaatcagttcctgatcctcatcgtttccgacactcacaaccgtgcccacgtattcatgtccgagggttaccggataaacctttgttcccagctcatagactctcggaatgtcggagccgcagatcccgcaggcgtccactttcacgagaatctcccgtccctgcggctctggaacttccacttcgtccaatgtaaatttccctatctcatgaagtctcatcgctttcattaatgtatcccccattctataagagcccggcaacatccacaaccttgtcggcaggtattacctggatcttcacctggattccctgatccagaaattttctgatcgcatcccgttcctgagggtcggctgcgatatttttatacaaagtctttcgttcgccgctgatccccatgcctccgatgttaattgcagggatgtgagctcccaggtctacaattttttcataggtaagcggtgtttttgccagcataatggacgggactttcaggccgtctttcagcgcttttgccgcctcttctacggagtaaactttcacctttaccccggccggagccgccatagtcagcacctgtgtcataaatgggtcttttgccactttatcatctgcaatcaatatttcttttgcaggcagaagcttcatccacgcggtcatcacctgtccgtggatcagccggtcgtctaccctcgcaagcaataattgttccatttttgtttcctcctattccaggtttgcgtgcttctcccacagagaatccacgtcgtcaatttccttttcctgcataatcatcagcgccgccgcatccaagagcagaagaagactctgctcaaacaggctgctcatgatctgtgcggactcgatctcgtccggcagggcaagctttgtcctgcacggaatcctcacgaacagatcctcatagggagccatggagctatccgcattggaaccgatatggatcaccgacgcaccgaactgttttgcctttttcacaagccccaggggaatcagactctcccctgagccggaaccggcaattaacacgtctttctcggtgatcgcgggctcattcacatctcccacacaaaatgcatcgatacccagatgattcagccttttagcaaaagcctccatcatcataaagactctcccgacgcctgtgacaaatatcttttccgaatgaagcaccatctccgtcagcgcccggacctcctgtccgtctaccgccgccagtgactggtccagttctcccataatcaattctttaaaatctttatattccacgttaacctccctgtcaccccagcgctgctttataactttccgtcattttcgcacaggctgttttcaggtctttgtccagcccgaacagcccggagcttccgaggattaaaatgtccgcacctgcctcggtgagttttttaaatgttgaagctttacaggacccgtcgatctgtatctggtagtggtatcccttttcttcccttatccgctttgcctcccggatcttatcgagcatttcttcgataaacggctgcccggcaaaacccacatccacggtcatgatagtcagcaggtcgatccggttcaggtaatgggcggcctcagacaggggagttgccgggtttaaaacaagccctgcttttaatcccagttcctcaatcctgttgtacaggcggaatgcctgaccgttgatggtctcagcatgcagtgatatgatatccgcacctgcctctgccaccgggtcaatccagtcttccggatttgtcgtcatcagatgtacatccagcggaagtttggagacctttttaaaacttttcaccaggtccggtgacagggtgatgtttttacagtaatgaccgtccatgatgtccacatggtacattcccacccagtcatttaatatgttaagctgttccccgactttcagaaaatccatacacatcagggagacagcaaacttctctttcataaaatcgtctcctttctctcaagccttagagctgtaaattgccttgcagatcgtgatttctttctgataaatctgctcaaacagctcactcaaatgttccagatcggacgtatgggtgatcagatcattcactttaagcctgcccgcatcgatcatatccgccgtatactgccattcattgagaggcatctgtgcgtaataagaattccatactcccgcgatatcgacttcttttctcagaatgctgctgtgatttgcaagttttaaggaagtgtccctgtggggatttccgagcatggcgatccgtccgaaggttcttacgatttccaccgcctgattaagtgctgcggaagttccggttccctcgatgactgcatccacatgatccgttcccatcactctcaggaggccgtcttttggatcttcttccatggaatttaaaatcgtcagtccccgctcttttgcaaatgcaattttttcttcgctgatgtcaaacaagaccactttcccggcgccgaaaatttctgcccagcgggccgccatgattcctatgggtcctgcgccaaaaatggcaatggtctgcccggctttgatccctgatcttctcaccgcatgctgtgccactgtggccggttccaccagactcagttcttcctttgtcacttccggattttctgaaaataccagattccaacgggaagggatgacacagtactccgcaaaaccgccgtcacacctggaccccaggtagttataattcgaacactgggcgtagtgcccggttttacaaaattcacactctccgcatgggatgagcgggaagacggctgccgtcttccccaccagttcctggtcctcttcccttgctgcttttacgatcgtccccgcgaactcatgtcctatggtaatagggtgaacatgtgctcccagctcaaatactctgggaagatcggatccgcagatcccgcaggcctccaccttcacgagaagttcttctccctttacctccggaaggggcacttcttccatccggaaatctccgattttgtttagtctcactgctttcatcttcacgccgttcctttctcctgaatgtcgagcctctttataccgtcatgtcccgcctgttcacagatctccgcaagttctgagagtgtcgtgtcctcctccctctgaagcgccgcggcgatccccatagccatattggctccggtgatgaccgctgccggatattcctggcacagcatggcaatgctgttaaacggtgtccctcctaaaagatccgtcagcacaaggactcccatgccggtgtccagctcttccactgcctgtcttaccttttccttaaactccccggggtcctggcccggtttcagagatatacattctgactgctctatgtttcctgctaccatggagacgctgtcagcaagtccctggcagagcagtccgtgactgattaataaaactccaaccatgtctcattcctccgtcttatgatgccacagccagcaggccgatcagggatgtgataacacctaccacaaagataataacgatgatataggtcggcttcaccttcttgctcagaagcttccacacgagcagcgtcgcgatcaaaggcagcattccaggaagcagagaatttaagatattttgaagattgattcctacttccccgactttaaatgcgatcggagtcttgatattaacccttgtagccgccatatttccgacaaccatcagtcccacgatactgaatgcttcggtgattctgtttaaagttcctgcacttaagatttttacgatggcactttttccctgtttatatcccatcatatacatggcatatcccataccgatcatcagaactttgtacgcaacctcaaacaggatcggtccggctacatttccggccaatgccaggctgcaggcgattccggctaagatcggataagcgataccctgggaaactgtgtccccgattcccgccatcggtcccattaatcctgtacgaaccgcattgatgtcttccgcgtcaatgtccgctccgttggcagactgttcttccatagatgcggcgactccatgaatcacagttccaatccatgaaggctccgtgttgaaaaataccatatacttctttaatgcttttgcctgctgttcttttgtctcatagagccttctcacgatcggtaccatggcattggttgtacccagtgcctggagacgctcatagttataacaggtctcgctggagtatccgagaagaaaatgtttgaccagatcttttttcaaaagttttttgccgccggtctgcacatcggcctcctcaggagaagctgtttcgatttgttccgcctcagcggcctgttctgattttcctgtaaagagatagatcaggactgctacagccgctgcaaatacagtcaccgccatggtatcaactttcgcgtagatggtcaggaagtaaccgataaagaaaaatgccacgattttctttttgccgagaaagcttaacaacattgcgattccaagtgccggcatcagtgccccaaccacatttaacgctgcgatcatcggctccggtattgcctttaaggcgttggttgcaaaatctcctccgaaatatacgagggcaaatgccggaattccgtagaggactgtggcagtgattccggacggcaggtagttcataagccttaatccgcggatgttgcctttctccaagtactggtctgccttatgtacccaaaaactgttgatagtcatataggcctggttgatcaggattcccagcagactgaacggcaccgcaaaggtcggcgccaggttcggagatgccccggaaatgatggtcagcgccgttccgaacactccggctaccatcaggttgcccggcatggttcctccggctgtgatccatccaaggtatgtaagctggatataggctgcggccttcatgccaaggaccggttctcccatagctaccgccacaaggaaacctgcccagatcggatacagccatgtacgggtgattgcgtggctgaaccaccactggcttccaatggcgatcaacgcgactaagattgctgaaattaacataatactttcctccttttctgttatctgatatgtatagtctaccggcataagaaaactgccgccataccaattaatttcctgaaatgcggaaagcggggatctgccccggcgcagatccccgctttcccctgttatttcttattcgccatttttgattcttttaagatctcatcggtgtcaaatgaaaaccattcgtcctggttttcttccatgtcatccatcatttccgggatcaggatcatgatgatcacaatgccgatcagaatggtcagagtcccgtagcttccgatccggttcagccagtctcccagaaatgctcccgcaaatcccatatccgcatccggaaatgtgacagaggcgtttgccagttcccccaagtacggcagaaaaatcaccggaagaaacgaaatcagcactccgttcaggaagccgcccagaatagctccccttcttcctcccgtagaatttccatagactcctgccgtggctccgcagaaaaaatgcggaacaactcccggaagaatcacggtgagattacatgcgatcatgataccgagagaaagaagccctcccaaaaatgacgagataaaccccacgatcagggcattgggcgcatacggaaagacgacggtgctgtccactgccggtttggcattgggaatccagttatccgcaatccccttcactgcgggcacgatctcattgataaaccagcgcactcctgtgatgaccacagtaaatcccacggcaaaggtcagcccctggacgatggcatagaccagataatcttttccttctgacagattctgttctacaaattcactgccgcaggcaagagcaaccaccacatacatgacaatcatcgtaatggaaacggtaacagaagaatcccgcaaaaatgcaagttttttcggaagacgcatttcctccgtggacttagagttttctccgtagattcctcccagccatgcagccagaaagtaagcactcccgccgaaatgtcccaaagccaccgagtcatttttacagatctgcctcgtatatttctgcagaatggcaggagaaaataccatcagaatcccaagagccagggccccgatggcataaaagatccatccgctgattcccgcgcctttcatgcatacgacgatcatgcctgccatgaataacgtctgatggccggtcacgaacacatagcggaatctggtgatcctggccaaaatcagattgaccgccatcccaagcagcatgacgacggaaatctccatcccaaacctgcccactgcaattcccgcggctccttccacactcaggatcacgccggatacgtgaaatccgtactgaaacatccttccgaaaggttccacactctctgtgatgatatttcccccgatccggatgaccataaaccctatgaccgatttaagagtcccctttaccgtggtctccaggctctttctctgcagcaccaagcctaaaaagacgatgcctccgaccacgatggacggttccagtaccaggtctctcagcatttttaacatatatatccctcttttatctttaagacaagaacgttgtcagtttctctctcaattcctcttcgtcaatcagggattccagtacgatcagatgttccacaggcggaatactgtcctttaaatcgtttgcaacgataaaatagtctgcgtccatggcactcatttcatatactgaggaatggcatgtctcaaactcctgctctctcccgagctctctcaggatcttctgtatattcatttccaccaggaagcttgatccgaggccggtgccgcagactgtcatgattcttttcattgttcttcctccatcatcataagcatctcctcactgcttctgcattccagcatctttttcaggctctgctttttcgaacagatttccgctatctgcttcatcagcacaaaatgagccgcctcatccctggccgccagcgtaaaaaatatgcgcactttttttccttcaaaatccaccggtgtgtttagttttatgatgcacagtcccgtggacaaaacacccgtctccggtttcgcatggggcatgcataccccttctcccagatagaaatatccaccgtattctccgatattgtcaatgatcccccggtaatattccccggtcaccatcccataccgctcgagtatctcacagctttttctgatagcctgtgtatattcactgacttcctccaagatttcggcacagatcataggctgccgcctccctcttcagatctaagagaaagaagttcctcataagaactgatatgcttaattctttccatgttgttctcccacgccagaatccggaccaaatctgccagattctcgttctcggtaatatttccgaggacaatgatgactttcacatctacctttgccttgctcccaaaatcaatgggatgttttagcttcatcaggctgatgcagttttcccgaacattgtctttcctcccgtgaacgaaagcaatctccggaataaacaccatatagttccccagattctgcacaatgtggatcatctcttccacatactccggcttcacaagtccatttttgatcagcggctcacaggccatggcaatggcctccttccagtcatctgtttctgcatcaaaccggcagtattcttcttttaaaaggtccccgatgcccctctgcatcgtctggtggattctgtgaaccagatactggttctttctgttgtatgcgaggacggaaataatatttttcacccggtcgatatccggagaattcaagagcggatttacgtgaatgacctgctgatttctaagactcagcggaactgtgctgatgataaagtcgggccggtttctttcagtttcctcctccacatcactgaccctgcagatttttctgacccgaagttccggaaagtattctgaaatccgctgttttaaaagcactgctgtcgccgtgcctcccccgcagacaagcacgacctccggtgacagattcaggctgaagttttcctgaaacagcacttcaaaatacatggtcgtataggcaatctcagcgtcgggaaataccacgcccagcatttcttcctgccctttaagcagccgttccgtcagctcatacataaaggaatgggagtacttgatatcctccatcaggggattcttgatctttattttatttttcagccggaacaccgccacttttaaatgcatcatgatctgtctttgaatctccgggtcaatctcactgctgatctttaaatcactgcaaaacttccggatcagctgctctgtagcctgcatcaccctgccgtcctcatcccaattttcaagactctccccgtccatccgcttcgtgctctggaacagcatgacaaaatagctcagatccccttttgtcacctgaaaaccggggaggcctgaaagaatcgcttctctgcaaacgccgtccgcgtcgtccaaagtgcggcccctgacatgaaacccgcaccggattcggcacagtgatgcaagaatcatgctttccagttccccgatggattcatccgcaaaccggatgcccatggccgcctccactctccggatcatgttccttcctgcttccgggtccacttctgcatgatctttcaaaatgtgcagtatgttcagggagccttcgctggccgtctttatatataaattaaacagtgtattccgtatttgttcttcctcgcctttcagggacatgccgtaataggacttttttatgagccgtacctcatgcttctttaaaaattcttccgccggcctcaaatcctgtacaaccgtattcttgctgacctgaagcttctcagccagctgctcgatggtcactttctctgagatcatcagcagaacagtaataatgataactctctcttccctggaatggactttgatctcattgctggaataaaggcttgtgatatcgaatccctttttgacaatgagacggacaccgagtcttggtgtgcgttcgatttccaccggcagttctttcaaataatattggactgcatccagatcgttgcggatcgatctgctgctgacatgaaacacctctgccagttttcccgccgtcgtataaccatcacattcctgcaggtattttactaattgcaactgtctttccgtcaacaatgtcctctctccttctactggagtttatcaaaattgtagcacatttgaaagcctgaaagctatgccaaaagctttccacatatgcagaagttcttaagatgttccaaaacgagaaaccgcctcttcatatcaatatagtacaaaataatgattttataagacaagaaatgcagctgaaatgatgatatattgcaattacagtgataaacaatgaaaatacaggaggtatactatgaaaaagatatcaaaaaaggctgaagaaatgacggtaaaagaactggcttcttatatcgactattccgttctgaaaccggagtttacagaagaacagatcatagaactgacaaaagacggagtgaaattaggatgtgccaccatctgcatcaatccgggttatattgagctttgtaccccgtatgtggaaggcactgaaacgggcctctgtccggtcacggattttcctttcggaaccagctctaccgaatccaaaaccgcacaggtcgagatcgcagccggatacgataccgtgacggagatcgatgttgtggcaaactttggcctgatccgctcaggagaatatgaaaaggtcactgcggacctgaaagcctgtgccgatactgcacacaaatacggcaaggaattaaaagtgatctttgagactgatgctctcacagaagaacagattaaaaaaacctgccgctgctgtatggaggcaggtgcagattttgtgaagacaagtacaggtttcctcaccggatatgaactgcggggagcggcgccggatgtcatacagctcatgatggacgaagtaggtgagaagtgtaagatcaagggaagcggatgcatccgcacgagagaacatttcttacagctgatcgatatgggaatcgacagaatgggtgtcggctacaaatccgttcctgttgttttagggctggaatcctgaatgtaatttccattcatcttccggaacctggacggcggacactggtatttctttttaaacagatgataaaaatgactcagggaagaaaagccgcacagcatgctgatctctatgatctctttagaggtctgtgtgagaagataaaccgaatattccagacgcttactgttgatatactcagttggagtcacggacatcacagacttaaataccctgcacagatgattggaagaacatgaggacaattcgatcattttcggaaacccgatcctcaggttatcaaatttctgcatctcgttcagcatgggctgaaaccaggaaggacagctggctgtgggaaactcctccgtgtcataggaaaagaaataccttgtaaatacgtctgcaagacagcatttggcataaaatacggttttttgaatctttggtgtgtccatgagggcgccgatctcctcaaaccgtacactgatttcctccctgccggatttatctaagcggacacacggcggcagctccgactccgtcagcgtccggagcatggccgtgtgatccagaaataaccgtatattctgcagcagctgttcactgaatccgatatttataatacggaagtcatccgaatagtagaactgatagctgtgggtatctttcggccgtataaagacaagatccccctgtgtgatcgtctggatggaatcattgacaaggtgcagggcacttccttctgcgacgataaaaaattcataaaaggtgtgggtatggatggacgccgtctgccgaaaccgggaattccgatacaggagcccggttttttcatccaaaaatgtatgttccattccgtagacaggaatattacccatgatgacctctctttttacaaaaatacttctttctctgtaacgagttaatcttacacatggagtccagtattgtcaatgagttccgcatcaccaaatttttaattcatacattacagctttttccatccccattctaattctgtcccttgggaatcacgttttgtcactccccagtgatagatcggcttgtcagatggcttgatcttagaatgtgttgacggataaaactctcctcccagattagaagaagaataaataaacggtttatcatacagttcatttaatgcagtataaatactgatctgggactcaggttttacttgctcaataatataatctaataccgatccttcttcctcatcatagagataaaatccttcctctatgggatcatccggtaattgaatatcctctgaattctgtattccggtatctgaagaaagaagattaccctcattattcacataacaccagaactgcgggtcaaactcctctccgatggaagaattccacctgctgtttccatacctgagattttcaggagcactgtttaagatatatagaagcttattcaaacagtcacataggctctccgcctgttccggactttgaggctcaaggttaactgcaataatttttatcaattctattgaatttagataggcttccgagttttgatctaaatgtgcaactgcaagagaaaggttatgcagattcgctgctgcggcttccggattatcagaaaagtttgacagtgtataaaaaattgttttctctatctgagaaaagctaaaattatgacacactgccgacacatccggaaacaaatctttgattccctcatcaaattcccgccctgcatttttattaatataaactccatctttaaatgcaaatcttcgatatgtacccataaaaacctcctgtctttgcttttcatccggtttcttttatgacgcaaatataacaggaggtttttatgatgtaaatgcttttccagtgattaactgttctgacagagtgaataacggccgatgactataccttctcaaagaaaaacaaaagaacaggagcagtccattttgaaaatatctctcctatatcaacattgtttatttctacatgatcggaaccttcgtagtcctctccatgatataaaatccgattaatgtatccgtcatctgcataagttacttttacccccttttttggaaccggatattcttctctgatcacaagtccttcttctaactccgagttttttgaaagatttttatcttcttctctcagttttttgtgcggaagtcccccttttaaaattttataatgactgctgtctacaaacacaatctcactgcccggctgcattggttcaggtatctcggttgattctattatttgttctcgtccccttgcctgactgccggtgccaaacatcagcagaagaaaacaggagattacgaaacaccataataattttctctttaacattcatacacctcctgcaagccttttatttttttacaacacatgcattgttgatggcaccttctgttccgggatatcgaaacaaaattttttctttgtgagttttcaggtcataggataccagtttatcgggatctcccagtccctgcccctttttcagcccatagagagtcgttcccttcctgtccaggtagataaaacccatttggtataatgatttatctttctctgataaaaccgttttcttttttgactgaaaatcataggataccacttctatgatctgttcttttaagcctttcatttcgggaacattgggcacgcttgtatttttccttatgtagagcatctttcggctgtttgccacaagagaaccgatgatcttccttttctcttctgtgatcagtctgaaagatccatccggtttgatttgatagaatctttgtctgatcccattttcaggttcattaagccttttatatgattctctgtcggaataaagattacagtacaaaccctttgtcaaaggattgtatgtcacgtaatccacaaagagatcgtgatcccatgttaaatctgttggctttcctgtctctctgtcacaccagtatgatgtaatgattgtttttttcgtatccattgcagcaagatacagcttatcttctttgataaacatataattcaggacatcacaccagtcggtcagctgccttgtttcctttgtcctgcagtcatatacaaagacttcatcctcatgtgtcccttttaacctggatgaataatagagcagctttttctgaggatcatatacagaaagcggatattgagaagtatacggaaccgttgctatcttttttgttttcgcagttttcatgtcaaacagataaatatcactctcaaatgtacctgccttttgtccgttcctggttgtcataatagagatcgcaagctgatcttccggattcgtttgtaaagactcatgtttctggcagcccgtcaacaaaaacatcagcgataataatgttattacttctatctccttcataaatttctgcatcctgcaatcctccaacggcagtcattattaactaattcaataatcaaaactatcattacaatcattatatcataagactattttgccgcaaactatttcaaaaaattacgccacataaaaagacagatcctgtctgcatacagaacctgccttctttcattatcgtattctttagaagttaaacccttcaatcgtagcaaaataatcttccggcgtctcagcccttctgatcatctccgtgcttccgtcctctttcaataaaatctccgctgattttaattttccgttgtagttatatcccatggcaaaaccatgtgctccggtatcatggatcaccagcagatctccgttctcaatctcgggaagctttctgtcgatggcgaatttatcgttattttcacagagagatccggtgatgtcatacatgtggtcacacggctcattttcttttcccaccacagtaatatggtggtaagctccgtacatcgccggacgcatcaggttgaccgcacaggcatccacgccgatatattctttgtgggtgtgcttttcatggatcgcctttgtcaccagatgaccgttcggcgccagcatatagcggcccagttccgtaaagattttcacatctcccatacccgcagggacaagtacttcatcaaaagccttgtgtaccccttcaccgatcactgcgatgtcattgccctcctgatccggaagataagggacaccaacgccgcctgagagattgataaatccgatgtgcacaccggtctctttctggagttccactgccagttcaaacagctgttttgcaagggtcggataatactcattagtcactgtgttgctggccaggaaagaatgaattccgaattctttgacacccagttctttcagttttaaaaacgcctctgtcatctgagccctcgtcatgccgtacttagcgtctccggggttatccatgatatctgttccgagagagaacacaccgcccggattgtaccggcaggaaatgacttccggaatgcctgctgcttctttcagaaagtcaatatgtgtgatgtcatccagattgatcgtggctcccagttttttcgcaagcacaaattcttcagccggtgtgtcgttggaagaaaacatgatctcacttccatcaaatccgcagcggtcagacatcataagttctgtcagtgaagaacagtcggttccgcatccctcttcttttaaaatctttaagatcgtagggttcggtgtcgctttcacggcaaaatattctttaaatcctttgttccaggaaaatgccttatttaaattccttgcagtctcccggattcctttttcatcatataaatgaaacggagtcggatacttctttacgatttcgtctaattgttcttttgttacaaacggtttttttgccattttattgattccctttcttgatttctaatagttttatctcattggcgagagcgtctttgaatacctctgccagattatgattgctggaatacagacaggctgcattataccggtccacaagatcgcccgtgagcacataggtagagtctgtgatcaggcggatctgttctttcttatgctccgtcagatagatgatggcccctttaagctcaaaaggctcattggtaatgatcactactttgatgccgcggccggctaaatcggtaaaatactcccggaacatgttcagcttttcgttggaagcagacacatagacccgttcttttgtctccctcagcatattcgtaaacttgtcaaggatctgtctttcccctttaatggtcagatatgcccccttattaatcctctgtttcggaagttttgcagcaagctcttttttgctttttttcaagtcccggatcttattgtcacagaactcctccacaggcactgcctgatatttcacagtgtcttcctcggacatataggcggcccctttttccacaagtcctgccagcgcattgtaggtgttggacctggagatgccgctttttttcgctgcctcatatccattcagttctccctccaagaccagaagaacatagagattcgcttcctgcctggtcagcccgaaattcatcagacattcaacattttccattctgcgcctccattcgtgttcctttataggaatactataatacggcgacatttttttgtcaataaacgataataaaaaaatgatcattcagcagctgtgcttcttatttttcttacggtacatctttttatccgccaaagaaatcagcttgtccagcgacaggcagtcatccggaaacacagcgctccctgcgctgcatcccttaaacggtatataacagtcagtcacactgaagctgaggtgtgaaagcttttctaaaaattcttccgggtctttttccataaacagacagataaactcatcgcccgacatacggtacagcataccctgatttttcaaaaacttttctgtcttccctgcaaatacacagagatactcatctccggccagatgcccgtacagatcgttcacctgtttaaagcagtccagatcgataaaaatcagataaaatctctgattcttccgaatcaattcctgcgcgtcatggaacaggctgttgcggttttttaatcctgtcaggctgtccatataggcgatctcttttaaatcatttatatttttataatttactaccagataatatataataataaaattcaaggtgacattcagcgccagcacaagcagacatatgactttcagaatacggttttggggataagtaaattgtacattaaacaataccatagttaaaaaccagctgagactgaagatcaggaaaatattctttgttccgtcttccatgaacttcagtgctcttaccagcttctctctgatccatgagacaaagaatactgacgtaataaaataaaggagggtctggactgcaaggaccgtaccggcaaaattttctgtctgaaatatcttcacggcatggactgagacagagaaaatgagcatcgtatagatccaggatgaacaggcaatgctgatgatccttttccatggttccgcatacagatatttcagaggaaacacatacatggctcctatcagagcaaacatcccatttccgtttccgaaattctttcctctggacaggactgcatatgatacagtaaccaaaaacaaagaaaatactgcgatgacaaaaactgtctttatcagagaatactttctcgtgcagcacagatttactacgttcatattgacggtcagcatttccagagccacaaggagattcaccagtatattcatatctgtcagtcctttcccactgattttcagcctttttttattatactaaatactgctgaaaaaatcacagacattcataaaaatactgccggaaactttcacttaaaatttttcacacaaaaagcgcatcccatctggagatgcgctttccttcatatattattttactcgtctgcttttccctcagatccgaataacttgatctttgtgatcaccatgtctttgatcgcatctgtaccaggagcaagtaatttacgcgggtcaaatccttttccttctctgtctttgcctgcttcaatgtatccgcgtgtagcctcggcaaatgcaatctggcactctgtgtttacgttgatctttgcgactccgagagtgattgcttttttgatcatgtcatcagggattcctgtaccgccgtgcagtactaacggcatgtctcctgtcagcttctggatcgcatccagtgtctcgaagcttaatccttcccagttttcaggatattttccgtggatgtttccgattcccgctgcaagcatcgtaacacctaagtcagcgactgccttacactcttcaggatctgcacattcaccttttccgatgactccgtcttcttctccgccgatggaacctacttcagcttcgatggacattccttttcctcttgttacctgaaccaattccttggttttttcaatattctcttcgatcgggtagtgtgatccgtcgaacataacagaagaaaaacctgcttcgatacaagcattgcatccttcataagaaccatggtctaagtgaagggcaaccggtacagaaatgtttaatccttctaacattccgtttaccattccaaccactgtcttgtatcctgtcatatattttccggcaccttcagaaacacctaagatcaccggtgatcttgtctcttctgctgccaataagattgcctttgtccactccagattattgatgttaaactgtcctacagcgtagtgtccggcttttgccttattcaacatctcttttgctgatactaacatgataaatcctccataattctttaatgaattgttatttttttcacatcaaacttattatatcctatttggccaagttgcgcaagtcacagggttcccaaaaaagccgggactaacagagaaaacttactgcatttattccagccgttcctgctcttatatccgtatgagcagcatatacagcactgttccgcctgcaatgctgagcagggtgttcctcttccaaaggtgaagcagaatgactgccgcccctgccgccaggctccacagtttctgaagagcaggctgaattgtcagttctttaaaacaatacaccacaagtgccgcgatgatagccgccggaagtacctttcccagatagccgatcattttaggcatgcctttctttcctccaaataatacaaacggaagtactctcgtaaaaagtgtgacaaatgctaccactgccataatagaaaccgccttcatcattccttacattcccccttttgctcctctcttataaaaccaaggcacatgactgccgcaagtataagcagtgagggcagtaaaaaccggtccggtcccaacagaatcaagaagaaaacggaaacagcaagtcctgctgccgctgcgccgtgttttttggaatttttccactggtccagaaaaatcaccagaaacagtgctgtcatggagaactcgatacccttaaaatcaaatggaagcagacctcctgccagtgccccgatcagggaaccagctgcccaataagcctgatccagagctgagatccagaacatgatcctgggttccgcctctgttttctcatccggaatggagcagaggaccgaatacgtctcatctgtcagagagaataccatataagggtaatatctgcccattttcctgaaacgctccacgaaggagagaccgtaaaacatatgcctgccgttgataaacagtgttgtgagcgccacaaggcccaatggcgctcctgctgcgagaaaagacactaagacaaactgcatagaaccggcatatatgaacaggcttgcagccagtgtccagaacggcccgtatcctgcctttgacataaggatgccgaacgcaattcccagaaatatatatccaaagaaaaccggtatggattttgtaactgcatatttgaaatgttctttcgtatttctcactgtttctaaccctccaggcattaaataagcttttccaggagggccacagatgccatggcatcctccgcatagtagtcggctccgatactatttgcaatatcttctgtgagcaccgctcctcctacccagatcggacagctgcagtcctcctcccggagtctttgaatggttttttccatcgatatgaccgtagtcgtcatcagtgcgctcaggccgattgccttcggctgatacttcttccatgcctctactaccttttctatcttcacatctttgccgaggtcgataatccggtagccatagctttccaggacgactttgacgatgtttttcccgatatcatggatatcaccctccacagtggccatcaccaccggtcctttttcctcgcctgcatctgcggtgaaacactgcttcacaacctcaaaggctttttttgtcgtctctgccgactggatcagctgagggagaaagatcttccccgtctcatagtcttttccaaccacattaagagccggaataatcacctcattgatcagtaccagcggttctttcttttccagttcttctctcgtctttgcctccacttcatccttcagtccgtggagaatgatgtcgtggagagagaactctgtctgaactgctgctttcgtctctgccgcatttgactgattcctgatgtagctttcactgtcgatatctttataaaacaagacatgaaacgcatcgatggtgcccatcagctccttatccagaggattgatgatcggcagatccagcccggcctgcatggcaagtgcgagaaatgtccggtttaagagcggacggttcggaaggccgaaggagacgttggagacgcccaaaacagtatgcactcccagtttctttaccatctctatcgcttttagcgtttcctttacttccttttgctgtgcagaagccgtcagggtcagacagtcgatgataatgtcttctttcccaatgccgtattccgccgccttcgcaatgattttttgtgcgatttcaaatctctcttctgctttcagaggtattccctcatctaacgtcaggccgattacaacgccgccatattttttcacgatcggaaaaatggcttccatgacttcgtcttttccgttgacagagttgatcagcggctttccgttgtaataccggcatgccagctcaatggcccgggcattggaactgtcgatctgaagcggcagggtaatcacttcctggaggagttttaccacatgtttcatcgtctccggttcatcgatacccggcagacccacatttacatccagcacatcggctcccgcctcatcctgtttgattgcctccgataccagctcatcataccgctcctctttcagggccagcttcagtttcttctttccggttggattaagccgttccccgcagacgatgacccggtctccgaatgtaacggtttttgtctggctggacaccctcgtctttttttcaatctttctcggtgccgcttttttcggagacgcggcttttaacttccggataaattccggagtcgttccgcagcaccctcctgcggcggagatgccgtctttcaaatatccctgcataagctcagcatattcatcgctggtcacatgataatgggtctccccgtgttccaggcacggaagtcctgcatttggctggatcatcacaggcacagaagatacgcttaaaatttcttcaatgatcggccccagctctgccggtcctaaagaacagttgacgcccagcatatccgctcccagaccctgcactgtatttacaaaggtgaccggatcatttccggacagagtccgcccgttctgttcaaatgtcatagtcacaaacaccggcagagatgtgttttcttttactgccaggataccggctttcacctcatacagatcgctcatcgtctcaaacagcaccgcatccacatcatgtttcaccgtttccacctgtgaaaggatgatgtcataggcttcatcgaacgtaagggtacccatgggttctaaaagctgtccgatgggaccgatgtcgagtacgatataggcatcctgttcacgccctgcattttttcttgcctcatttgcattggaaaccgcggcgcgcagcatatcccggtattcgtattttgactcctgcattttcagttcattgcatccgaatgtgttggtcgtgataaagtctgctcctgccccaagatatttttcatgaatcgatacgatcagctccggtctgtcaatatttaattcttcggggatatctccggcgcggagtcctgcctcctgaagctgggtccccatggccccgtcaaatatgagtaattcttttccgattctgtctagtaacatctctggcctctctttctaaatgcacagtcttctttcattacacactgtccgcactgttttttcctctcaggcgtgccgatacctatgaaacccagcatggatttctgaggtatcatcagatgatccggcgtaagtgtgaccccgagagttttcccaacatcgagcactcttgcgatctccctgttgaaggacagcggaatatcaccatagcccggacagagccggtatgatctgtttggataccccagcccttcttcatactcatcgcagtaagcttccagataagcgcttcccgccgcatccataacggctgcttttgtcatattgcatttttcgtagtactttacctttcgctccagggtgaccccgagggtcgctccgataaaaaggcagtggctgcactgcaagaaagcctcctgtatctgatccccggggagatgaagtcccagttcttttatatagggcgtttcccctgacagctcaaatctgcgtgagataaccttgggctgggaagcctgtttcacctcccggatacaatcatccagcaggctttccatctcatccgtgatctgctgccccgaatgccctaagtatttcagtgtattttctttaatcatgattcagctcttttaacacggtcggaatatttccaaagatcctctgcgcgatctccggcttattcatcgtatagatatgaattccgtccaccccgtttgtgatcaggtctatgatctggtgggcagcatagttaatcccgatctctttcatagcctcaggataattataatatgtctcgatcatcgtggaaagctggaacggaatggagcagccgcacaatttggccgtgcgcagaagagattttgcatttgtcaccggcatgatccctgcaagaatcggaacatcaatgcctatttttctcgcttcttttaccagccggtagtaatagctgttgtcaaagaaaatctgggtgatcaggtattctgcccccgcatccaccttctttttcagtgcttctaaatcatcccggaaacagtctgcctcctgatggacttcgggataacatgccccggaaaggcagaaggaatccccgaaattttctctgataaatccgttcagttcgctggcatagtgaaactccagatccattccccggtatttttcttcttctcccgcaggatagtctcccctcagtgacagaatattatcgacattgtgctcctttaatgccctgcattctgtgagaatatcttcttttgtggatgtaatgcagcttagatgggctacggactcgatctgatacttatttttaatggccgatgcgatctccacggtctttcccttggaagatccgccggctccgtatgtaacactgataaaatccgggtccagttttgccagttcctcaatggtatagtaaatggaagaaatatccccttctttgttcttgggcgggaatacttcaaatgaaatggtggccttttcctttagtaattctgatatcttcatctgcttctcctttattcctgtaatacattaaagcaattttatcatgttcgattttctctgtctacacagaaaaagcgatgtctgacaggcttctttcagcctgagcagacatcgttttatccgaatctttctattttttaactgccttaaaagcttcacttagatcttcaagaatatcatctatgttctctgttccgatggaaagtctgatagtatttgctctcagcccctgttctttcaattcttcctcattcagctgtgaatgagtcgtagatgccggatgaatcacgagagatttcacatcggctacatttgccagcagcgaaaagatctccagattgtcaatgaactcttttgccgtcctgtcatctcccttgatctcaaacgtaaagatcgaaccgccgccgtttggaaaatatttttcatacaatttcttttgttcttcatctgcggtcacagaagggtgatgcaccgcctccacctggggatgctggctcaaaaattctaccgttttcagtgcattttccacatgcctttccactcttaaagataatgtctccaatccctggagaaataggaatgcgtgaaatggagaaagggctgctcccatatctctaagcagaattgcgcggatctttgtgacgaatgctgctctgcccgctgctttcgtaaagctgatgccgtgatagcttgcatttggctcggtcagggaaggaaatttccctgatgcctcccagtcaaaatttccgctgtctacaataacccctccaatggcagtcccatgacctccgataaattttgttgcagagtgtacgacgatatccgctccatactcaatgggacggattaaataaggagtcccgaatgtattgtcgattacaagaggtatccggtgtctgtgtgcaatctctgccatcttctctatatccgccacatccgaatgaggattgcccaatgtttcaataaacactgcttttgtgttttctttgacagctgcttccacggctccatcctcaaaaatgtccacaaacgttgtttccactccgaattccggcagcgtgtgggccagaagattatagcttccgccataaatattttttgctgctacaatatgatctccgttttgtgcaaggttttggatcgtatatgtaatggctgctgcgccggacgctgtggcaagtgccgccgctcctccttccagagctgctatgcgctgttcaaatacatcctgagtcgggttggtcagtctgccgtaaatgtttccggcatcgcttaaatcaaatctggccgctgcgtgctcactgtcgtgaaagacataagaagatgtctggtaaatgggaactgccctggcgtcagtagccggatcagcctgctcctgtcccacatgcagctgcagtgtttcaaatttcaaatttctctcttctctggatttcttctgatacatggctttctctccatttcctatatgactggtatgaattgttttgttgtattataaaaagcatttcatataaagtcaataggaaattggaattttattgattttcattcgtgctcaggatttatcagttttctaagctgctgtaactccttcctattttgtcaaagtccagaaccgctgcgtcgtcattttgaaaaacagctccggttccttttgcattcattgcccgggcaaatccaagcttatttaacatggaaaatactctcctcactgttgagacactgacactgtactgttggcaggctatgcgtatatgtacacagatttatgattgatgaatttgtgagacagtggtattattctaagggagtattattggggtgataataatgacttatttagtttgttttctttttctttctgtaattcttttttacaggctaagacaaaagcaggttgaaaggatcgcattcacagatgcattgacaggaggaatgaatgatacggcatttcgggcagcatatgaaaaactggcggctcggatggaaccttccacttatgcggtcgtttttctaaatataaaaggctttaaatttataaatgaatattttggatctgctgcaggaaatgatacattaaagtatatctacagtaagctcatccggcacatctgcaccggagaaatagctgcccgggacaattcagactgtttttttctttgtctgaaagaacacagcaaagaagcaatcagataccggctccagaaaatgactgcagatatcaattcttttaatgcatcttcagatattgaatatcagtttactattctgcagggcatttatcttgttgatgacccgaaactggatgtcacgatcgtacttgaccgggccaggacagcctgcagacagcggcacggaacagatccgtgttctttctttcatccggagatggcaaaacagatgcagttagagtatgaactgaacactatgtttgaagactccataaaaaaacgagattttcagatctatctccagcccaaggtcagattggctgatctgacactcagcggagccgaggcattggtcagatggattcatccggataaaggcatgatctgtccttcagactttataccgctgtttgaagagaacggtaaaatttgcagactggatctgtatgtatacgagacagtctgcgcttatcttcataagcggatagaacagcagaaggatctgtttccgatatccgttaatttatccagagcgcatttcaaggacctgaattttctcagaaagttttctgaattaaaggccaagtatgggattcccgacggtatgattgaatttgaattaaccgaatacagttttttagacaagcagcagcgggagatggtgaagaactgcattaaacaaatgcacaggctgggatttcattgtgccttggatgatttcggtgttgggtattctgcacttgcactgctgaaggattttgatgtggatacaataaagctggaccgtcagttctttgtcgatatgacaaacccaaaggcccagacaatcatctccggatttattgaaatttcagagaagttaggtatccatctggtagcggagggaatagaaacaaaggaacagatggaacttttaaaacagttccattgtgagatggttcaggggtattatttttccaagcccctgacaatcgatgaatttgaaaaatggaaggatacaatgcagaagcagaaagtattcaaataatgaagcagtgccggaacctttttcgtttccgcactgctttctgtgttacacgcatttaattaataaaaatctcccaaataatcataatgataaaaatataatcttatatctctcagtataccaaatccaaaaaatactgccagtcccacatacagcatccacatacggaaacgaaagatttccccagttccctttcctgttttcctgaccaatgctccaatgccaagccaccccgcaatcaatacaagataggcaaacgttggattgcatttcagcgatgtcaaaaaatcaagccttaaaaaagccagcgccgccctggtccctccgcaggcggggcagtaaagattggtgaccagcttaaatacacatggaaatgccggaataaattttagaatcttctgcatcatttagatttcttcgtcccagttgtcacttgtgtctacatcgtccgtatcatcccaaaaatcatcgttatcaggcttggtgtcatgagtatcataattattaatgtagctctcaaaatcgccgcctgcaagatttacagccacgaaaacagtgatcatgatggagaggaccagtccgcagatgccgcagatcagacctgccacagccttgccgtctttctttcccatgtatttcggggaaatacagaataatacgatcgcaacgatgccaaggacaaatgataccggaaaacagcagcaggccagtgcgatcgccaggacacccagcacaagagagaccgttgcataattgttctgagggggctcttcctgactctgatatgccggtccgccggtctggcctccctgatatccgtaattcgcctgttgattctgctgataataatatccgctctcacctactacaatcgtatcagatgaagctgtctgagactgcacctcctctgcttccggttcgctttgaacttcagtctctctctggatatcattctcttcctgactttcaaactcctgcaccggttccttgatctcttctcccgtataagggtcatatctcttctcttccatatatttttatgctctcctttcctttaggtatcttatcatgccgggtcccagactctcatttggcctggaaataaaaccatgggcctcataaaaggcttcccttccctttgcacacatcaggtccagcatcatctctgtgtcatcctcccggatactctccacgaaagcaatcagattttcaattattttgcttcctacacccgccttttggtagtccggatgtatcatgagatcctggatataacagatgaccgctccgtcccccacgatccgccccatgccgacgatcctgtcatccgcataggccgccaccacataaagactgtttttcagcgccttcacggcctgagtcctggtgagctttttaaagcctacggcttcccggagccaaaggtaggtatccactccgatgtgatttgcaactagtgtaatcatcttcattccttctatctgttgtaattcattttgatattataacacgaagcccggttttgtgatataatttaataaaaaaagtgaggagcctttatggattttcaaatactcgactttatccaaacacatgtaagaaccccgttcctggatgatttcttctccaggatcacacatttaggcgacgcgggcacgatatggattctgatcgccgttatccttctgttcacaaaaaaatacagaaaagcaggtgtcggcatgctcattgccatgctggttacttacatactgggggatcatatcatcaaacctttggtgggccgggcaagaccttttacctatcgggatatcaaacttctgattcctcctccgggccggtattcttttccgtccggtcatacagcttcttctttctgtgccgccgtatccttgtttttatacgacaaaaagctgggaatcccagcttttgtcctggcagcactgatcgcgttcagcaggctgtatctgtatgtacattatccaaccgatgtcctcggcgggatcctactgggcactgtctgtgcagtcactgtgttcctgctgcttcgacgcaatggacacgtcgatggaacagtctgaaacgtggtctgagttaatggacagtccgtagtcgatgtgcagcgccatgctgtcctctttctcctcaaagtcgatcttgcttgtgttgatcccaagcaagagacttccgaaaggagtgtcataataagtgaggttttcttttccccgctcaaataccatatgggagctgctggctcccttttttgttacttccacgaccttggggctgatcttaagacggttttttacgacctgggaatcgtcggtcagctcatcataaatgacatagtgctttccgtttttcagatagtaatcccctgtcgtcatcagctcaataggttcttccgtaccggcatccagctgaagaccggaaatattgataatcacttctttgttcatttgtctcctctaatacctttcaatatctatgggctgtactttttccacatgacagggcagaacccggtccgcaaaactcagaaactgatcttccatatcgctgacataataatgatactcagctgtatggccgctctccgcctccatctccctttctttcagaagttccctcagagatttcgccgtctcgtaggcgggattgatcaaggttacattgtcacccacaaaatttttgatgggattttgcagcaaaggatagtgggtacatccaaggatcagggaatcgatctgatactggtcaaactcccgcaaatatctggataccatgtcttctgtgatcctgtcgtcgatcagtccctcttccacgaggggcacaaacagagggcaggcttttgtcaccacggttacatccgggttcagttcccttaaatactttccatactggccgctctttacagtggcattggttccaatgatgccgatatggtgattcttcgtggccctggcggccgcaatagcccctggacgcaccatgccgatcatgggaacgatatattcctgctggagcttgtgcatagcaagggcgctggccgtattgcaggctatcacaatggcctttacatttttgctcaacaggaaatttacgatctgcctggagtaccggatgaccgtatctttcgacttcgtaccatagggtaccctggccgtatctccaaaataaatcagactctcatcgggaagctgtctcatgatctccctggctacggtaagccccccgacccctgagtcaaatactccgatgggtgcattgtcatgtacactgctcatttttattcaaacctttcttccgcaagacggatcagctcgtctgcaagggccggcgttttgattccctgggccgcccagagcatcggatacatgctgatggacgtaaatcctggaagtgtattgatctcattgaacacgacctccccattctctgcaataaagaagtctacgcgggaaagaccgtatccgtcaacagccttaaaaatctcagctgcggatttccggatctcctctctcgtctcctccggcatcggaggatcgatcagggtctttgattcctggttattatatttggcatcataatcatagaaatcggcagcggccagaatttctcccacaccggaagccttgatctcttttcctccgaggacggcgcattccacttcccgtccaacgatggtctcctccactaaaatattgcggtcatgttcggcagcctttgacagtgcttttgaaagtgcttccctgtcctccgccttggaaactcccacggaagaccctgcccgggaaggcttcacaaacatcggataagaaagctttgcctctgcccggtcaagagcgtcctccatctgagttaagtcactcctgcggatatggacaaactgtgcctgccggattccaaggtcttccacaatgatctttgtataaaccttatccatcgataccgcggaagccagtaccccgcatcccacatacgggatctgagccatttcaaacagtccctgaatggtcccgtcttctccgtttaaaccgtgaagcaccgggaagattacatccacaggctgcagccggtatgtaccctctgcgaggagtaccaatgccttatcttctgtatccggagaaataatcgcattcaccctggattctctccagcttccgtcttcaatctcttttaatttatccacaagcagccagcggccgtcttttgttatccccactaaaatcacattatatttttcttcatccaggcttcgtatgactgtggcagccgaaacacaggacacttcatgttcggaggatcttcccccgaagatcacagcgatatttttcttcatctctgacttacatctccttccgagtgcgcaatgctatcatattcacgcttcgcgtacattatatcataaacttttcaaaaataaatccataaaactttctgcggtacttttcatattcctctctgctccggaacgtccatccatagaccgggattcccgaaatcttccggcacagctttagggacggctcctcccagtaaatatatttgtatgcaataaaatccggttttgtggcaaagttcgtcaaaagattctgttccgcccagtaggcaagctggttccccttatggtgatcctttctgaaattcatggacagctgcccgcgtatgacttccggacggtttagcctgaaccagaacagtgcaaacggatgaaaagattccatacagtagagtccccggtattgatccagcacttccgccgccagccggcagagtttccggtcacagtgctccattttcagttccaccagaagcggcacctttccgtctaccaaagccagcacatccgcaaaccggggaatccgttcttttgtctccatcagagaatatctcttaagctcccggtaggtcagatcacgaatcgttttgttgacaccgcaggttctcttcagatcgtaatcatgatggacgaccatcacatcatcttttgtaagctgtacatccagttcaatcccatatccgtaggtaaccgcattcctgaaagcctccatagagttttccggtatcccgtgaaagccgtggagcccccggtgagcaaaacatttcgtttccagcaccggatgttttcttggcttcccgggatagatcatatacaggtaaagaaagatacaaaacggaatcacaagtatgatcataactctcctcttttcttcctgacagcctgctccaatacttcccttttatttttggccggatcttctaaaacaagttctaaaagtcctgccagcatttctcctatttctctgccgggtttcatccccagactgatcaggtcctttccgtcaagagccagatctttcacctgaagacagtcctcttcctctttgatttcctcaaacagcagtctcgtacggtcaaggatctgctgcttttcctcctgcataaaagtgctctgggctgaaatatctgcctgctggacttttaaaagtttctcaaacagcggcaccgaaattctgctggcccagcgtctcacagtctttttgctgacctcatccaaagaaccgaaccgtacgtcatgccaatatacaagtctggtcacctgctttatggtttggttgtcaaatttcagtcttttcaaaatcttcctggacacctcttctccgatagtgttatgtccctgaaaactgtcttttattttcccttcgactctggcttcaggctttcccacatcgtggagcagcatcgtccaccgcagtatatggtccggctcagtattttttaaagcctccaccgtatgaactcctacgttatagcagtgatgagggttattctgaggtgtctccatcatccggtcgaattccgggagcaccacttttgtaacgcccagatcatatgcgtcaaggatcgtttccgggtgatcggacaggagaagttttgtgagctccgtctgaatcctctctgcgctgatatcctttaagaactttgcctgtttttgtatggcctgctttgtctcttcttctatcacgaagccaagctgtgcctgaaagcgcagcgctctcaaaattctgagcgcatcctcgtcaaaacgcctgcgggcatcccccacgcagcggatcgtcttctttttaaggtcctccactcctccgtaataatcggtcagtccatccctgtcgttgtatgccatggcattgatggtgaaatctcttctcagcagatcttctttcagggatttggtaaaacagacctcctccggccttctgtggtctctgtattctccatccacccggtaggtcgtcacttcaaatggttcttttcccatcatcactgtcaccgtaccgtgagcgattcccgtatcaattgtatatgaaaaaatctcctttacttggtaaggagatgcggatgtggtaatgtcccagtccgtagggcatttccccaaaatgcagtcccggaccgggccgcctacgacatatgcttcgtagccggcctgttccagctgatttatgatctgttttgctttttcaggtatctcaatcttaaacataaacttcctttaatatgcttttccgaaaagaaccatctttttggccggctttccgcagtgaacgcacacatccccgagatgttcctgttcaaaaggcatgcatctggtggtagcccctgtctcgtccttgatggcttcttcacactcggtttccccgcaccacatagcttttacgaagccctgctgcttttcgatgatctccgtaaactcatcccagtttcctgcctcgtgagtattctcctctaaatgctttttcgcccgttccagcatgtctttctgcatctggtcaagcacttcggaaagctttgattcgatctcgtcaagagaaacaaaaatcttttctctcgtatcgcggcgcacaatcactgcctggttcttttcgatatctttcggtccgatctcgatcctggttgggattccctgaacttcctgttcactgaacttccatcccggactcttgtcggaatcgtctacttttactttataatttttagaaaggcactctctgatctcttctgctttttcgagaactccttcttttttctgcatgatcggcacgatcatcgtctgtaccggtgcgattttcggaggcagcacgagccctgaatcgtcgccgtggaccataatgatcgccccgataatacgtgtggacatgccccatgatgtctgatggacatactgcagtttgttgttcttatcggtatactggatatcaaacgctttagcaaatccatctccgaagttatggcttgtccctgactgaagagcctttccgtcatgcatcagcgcttcgatcgtataagtggcattggcccctgcaaacttttctttctccgtcttctgtcctttgacaaccggaattgccaggtactgctcgcagaagtccgcatacatatttaacatctgaaccgtgcgctcctcagcctcgtcggctgtcgcatgggccgtatggccttcctgccagtaaaactcagaggtgcgcaggaacggtctcgtgctcttttcccagcggactacggacacccactgattatataacttcggaagatccctgtaagactggatgatattagagtaaaaatcacagaacagagtttcagaagtcggccttacacagagacgctcctcgagcttcttattccctccgtgagtcacccacgcaacttccggcgcaaagccttccacgtggtctttctctctctccaaaaggctttccggaataaacatcggcattgccacattttccacacctgtctctttaaatttagcatccattactttctgaatattttcccaaatggcatatccgttggggcgaaggatcatgcatccttttacactggaatattcaattaattctgcctttttaacaacgtcggtataccactgtgcaaagtcttcatccattgcagtgatggcttctaccagcttcttttcttttgccatgtgattgatctccttcttatctcttaatttatttaaaatatctttttatttctcatgtactgccttgtctgatgtcatcttccgtcttactgcgtattcttatcttttcctgctgctttaattccatataaaatgtggccagagaaacctgaacccatggagcgaccaccagaatgcccactcccaggaacagcagaccgatgaacagccgcgggagaaaaaacagccaaaacgcgattaatctcaagtaattaccatgcatcatgctgattccccgccgcactgccgggccgcatttctgctcttccccgtccagaagtaaatataatgcgggaaaataacgcagctctacgacgatgacagccagtatgagttcaattaatgaccaatatgaaggcttcagatattgtgttatgtttaaaatatcggcagtacaagaaaacaaaagtaaatacacattcatcattaaaacttttctcagaagcagccataaaattccttttgacttactctgaaatacataaaagatatattctacgttcgcttccacacccatagctgtcatcatacaagcaaaaatatttcctgtccaaaaaataaacatcagcagctgttttgaaatttgtatcagcaatgcaggcgccagaaaagggaacaacatcactaagcctattttccatgtttgaagacccatgacgatcattataataatgacttcaattataaccaaagtgcagaggctgtctttggcccttgtcttcgctaattcccaaatatccctgaatttcattctcttttatgccgccgtccctgtctttgccttttcttgttccttcaagtctttataaaatacagccatagaaatctgcagccatgcagcgaccacaaacaagccaattccaagggtcaggacaccgagcagcatccacggaataaaagaaagatataagaaaatcagcctcttataattccctttcatcaaatcagtgccccgccatactgctttctttgcttctttttcttccccatctatcagcaaatatattgcaggaaaataacgaagttccactatgaccacagctaatacgctggaggtaagaatgaaaggactgctgtcaacgtaaagtattgcgcctaataatccaccaaagaaactaaatattgccgcgtacacctgaatcataatacattttcttaaaatcacccataaaatcgatttcttcttttttaaaaacacataaaatacatcttctactcttggtttcaggccaacagaacacatgaaatatgcaaaagtaattcctgcaaaaaatgcatagactaaaaacatctctgcaatctgtatcacaaagttcaatatcatagaaccaatcagtctctggaacatgtttccccatactgtgatcccaatggtgataagtacaataatgatctgaatcagcactagcacctttaaattttcttttagtttttctttagcaaattctcttatatcctttgccctcattctctctctcatattctctctccttatttgctaccactcgtagcggtgcagctgcccttctctctggaaatggtcaaatccctgctgtctcagcacctcataggccacaatcgccacagagttggacaagttcagggaacggatctcaggaagcatcggaatcctgactgccgtttccttgtagtcaagcagaatttcctccggaatcccggcactctccttgccaaacatcagatagacgtcttcatccgcgcccccataagtgacatctgcataggtctgcctggatttcgtagttgccatgtaaatcttaggatgatgatttttctcaagaaaatcctcaaaattcacataagtcctcacatccaggtgttcccagtagtccagtcctgctcttttgatcatcttctcattcagtttaaatcccagcggttcgatcagatgcaggaccgcaccgcaggcaacgcatgtccttccgatatttccggtattggccggcatctccggctcatgcagaacaatatgcagcatgattatctccttagtttctcaataaatgtgccaagcctgctgagggcttctttcagttcgtcgatggaatacgcataggacactctcaaatatccctctccgcaggcgccgaaagctgttcccgggacgatcgcaaccttctgttctttcaaaagttcttccgcaaacttctctgagctcatgccaaattccttaatacacggaaatgcataaaaagctccctccggctcaaaacactcaagccccaattcccggaaccggtgaagcagataccgcctcctctggttataggaatttttcatctcctccacttcgtcatcgcaggcgcggagtgcctccaccgccgcgtactggctcgtggtcggcgcagccatgatgccgtactggtgaatcttcaccatctgctccataataattttcggagcagcggcatagccaagcctccagcctgtcatggcaaatgccttggaaaaaccgttgataacgatagtcctttccttcatgtccggaagcgcaccgatgctgacatgtttgtgtccgtatgtaagctcggaatagatctcatcagagattacaagcagatcatgctctttcgcaaaatcagcgataggctccaaatcttttttcgtcataatagcgcctgtcggattgttcggaaacgacatgataatggctttcgtcttatctgtcaccgcctcctcaagctgttttctcgtcagcttgaacttgtcttcctctttcagctccacagtgaccgggactccgtcggccataataacacacggcacatagcagacaaatgacggctgaggcacaatgacctcatctcccggatttataatagccctgagagccacatcgatcccctcactgccgcccactgaaacaagcacttcgtcattgtggtagcgcatgtggtattttctttttaaatatctgcaaatctcatccctgagctcaacgagtccggcattggatgtataaaacgtttttccctgctcaagagagtagataccttcctctctgattctccacggtgtgtcgaaatccggttcccccacgccgagggaaattgcttccggcatttcactcacaatatcgaaaaacttccgtataccggacggttccagcatcacggcttttttagacagcatatctttcattatggagtcaccgcctgtcttttatctgttttttttgcctccagcactgttccgtgatctttgtatttcttaagcacaaagtgagttgctgtactcagcactgcttccagaggagcgagctttgatgaagtaaacatggaaatctccttcattgtctttccttccagcatgaccatgaaatcataagccccggacatgaggtacaatgcttttacttccgggaaattgtagatgcgttctgcgatcttatcaaagccttctcccctctggggtgtcactttcacctcgatcatggcagtcagctgttccctgcttgtgtggtcccagttgatcagtgtatggtacccgcagataatgtgttctttctccatctcggcaatttcattggcgatgtctacttccgtagaatcaagaagaaccgccagctcttttaagtccagacggctgttcttttctaataattttaatattgattctctcagctcttggttcatgatctctctccaatcttatacaattcgtcttgtttcggagcttccaggcttgccgcctttccctgtctgtaaatgatcttatcgttggaacctgtggtacggccgatcaccgaggccttgatcccttcctgttccagttccctcacaagggcattcccgtgatccgtaacgatcagcatggagccgctggagatcagctggtacggattcagatcaaaaaactcacacagctcaatcgtatgctgcttcaccggaatatcctcgacagcaacttccagtcccacacctgaggcctgagccacttcccagagagcaccgtagatcccgccctctgtaatatcgtgcatggaggatgcatactttcgcgcaatcttcccctcagggacaaccgaaacctgttcaagacaggccttcgcctcgtcaagaaactcttccggaaaacgttcttttaacagttgttcctgttccctggcgataataccggttccttccaggccgatgtatttggtcaccacgatatcctgtcccggcttggcgcctctggtagaaacaagttcttcctctttgactttaccgatcccggtaacagaaataaggggctttctgaccacatcagtcacctctgtgtgaccaccgatcaccgcaatgccaagctttacgcactcttcctgcacctctgccgacagctgcctgagttctttttccttcgtctccggaggaagcaggactgtgagcataagacccaacggttcggctcccgaggagatcaggtcattggcggtgatatgcactgccagcctgccagcttctttggccgccccggtgatcggatcagtggaaagcacaaatacttccccctcatcaagcttcagagccgcacagtcttctccgataccgggaccgatcaggacttcgtcccgcctggtgcccagctgttctaatataactttttttaaagtggcttccggaatttttcctatcttcatgatattcccctgatcaattctctttggatgtttgagctgcctgagtactcttcttctctgtggatttcttcgcaggagtctttttcttctctgtggatttctccgttgatttttcagtcggcttgctgtctttctttttcttatctgtgtcttttttcttcttgtctttgtccttatctttcttcttggttcctactcgcaccgtgttcggagtcgccatatagctggacgtattgaacagaatcttctgtgtcttcttacccttttccttaacgatcttccaaagcttcgcagtgtagccggtatgcccgacctgttctacaacccgtttcccttcttccagtgtcgggtccttgatcgctttctctccggaactgtttctcactgaagtcgtctcagagacaaactccacgtgccggttcggattggttttctgtccgtagacgctgaacgtgatattagaaccgtcggcaattccttctatatatatagggaagtcatactggttctcaaacttcagatccttataagttccggcgatggctgcatcggcagatcttggcacataggatacggtcatagaatgagggtggcgttctttgatctttaactccgcccggatcaccgcattgtaaagtgtcgtagagacctggcagattcctcctccgtaagtctgcactgtctggccgttctcataagagcctgccaggtaatagccattctcgctcgtaaacggagaaaccgctttgtacacggaaaaagtttctcccggatatacaactgttccgttgatcatctttgcgccgttggcaacatttccttttctccccggtgcggaagatccgtaataggttgtctttgtccccagcttatctttgacttttgccatgtcttcgctggtatactccgcctttttccttgtaactttcagaggtactttgaaactttccgcctcaacctgctttttgtacgccttaaacgtactctttttgtccagcgcataccctgtcttttcttttatgatgataaactttccgttctttctctttaaagatgcatttttgggctctgagacaatctttttcgccgcagagtccagttccctgtcaaatatcttctggtcatagctgcgctcaatctttacgattatcttgtctttcttgacctgggaatagcggtttataatgcttcccgaacgtcccacgtcataggcatcctttactgttttctccacatcccacgcaacacctgtctttgaaagtttcgtcaccgctttcttgccgtccacatagaatgtaatatcctttgcctgttctttctctatataatcttcaatttcttttttcgcttcttctttcgtcattcctccaagggatttcccttcaaatataaccccttggactattttatgatctttggtagccccttttaccgtctgactgatatatacaaatataccaatgcagatgacggctaaaatcccggcagcaatgccggctttcattctttttgacatacctatccttcctaaaatgttcacgtctgcaaaattgttgtccttaattacaccattaaataaccggcgactgtcgtgccgaccattacgatcaccaaaaggatcgctatgatcccggcgatcattcttttctttttcatcgcatcaccccatattttgaaataatctcgtctattgtcctggaagcttcactcattgtcagtccgtctatgctgtcgttatcctctattttatgatatttcctcagttcgttcaagtaccgtttttgctttgccgtgatcatctggagttttttgggacggtactgaagcggttccggaacaaagaccttctggtcctctccgaattctctcttcatggactcaaatacaaccgcggttgccagtgcatcgtcataggccctgtgagccgcctgattgacatagtgataatgctcacagagactcgaaagctttttgctctccagcccgcgaagcagcagccgggcggccctgagggtatcaacaccttctttttcaaaagcataacgaaatctctttgccgcagttttcatgaaccggtagtcaaacatcagattatgtcccagcaccggataaccctcgctgaatgcgaggaaaccctccacgccttcgcgcatggggattccgccgtccagcatcttcctcgtgatccctgtcagccggatgataaaatctgacacttcccgctccggatagataatacagttgtattttccggcaatcttgccgtttttgaccttcaccgccccgatctcgatcacctggtcttcctccacggaaagtcctgtggtttccaggtcaaaggcaacgtactctctcataggctatacctcacatgaagggcagacgctctgaagggtacattccccgcatttcggccgtctggcgatacagacgttccttccgtgggtaatgatctgaatattgtagagaatccactgctctttcggcagcaccttcatcaaatcgtgctctattttcaccggatcgtcgttctttgtcaaatataattttttggagatcctttttacatgggtatccaccacgatgctcggctcatggaagatatttccccgaattacattggcagtctttcttcccactccgtccagagcggtcagctcctcaatgctctccggcacttcccctccgtgccgctcaatgatctggcccgcggctccgatgatgtttttcgctttattcttataaaatcctgtggaataaatatctctctcaagttccctgatatctgcccgggcaaatgcctctaaactcgtatattttttaaacagcttttctgtcacaatattgactctggcatccgtacactgtgcgcttagcatcgtcgcaatcagcagctgccatgcattttcatggtttaaataacatttgtattctgtcgtataagtctcgttcagaatatcacagatctttctcactcgttcctttgttactcttttggatactttcgccataggtttctgctccttatgagtttcctccgatagtttcttctgaccggtagcggtcatgcagtgtgaggatcgttttcctcagttcactgttcagctgctcttttgtgactctccactcccagttgtcccccaccgtggaaggcgtattgatcctggcccggcttccgagccccagataatcctgaagcggaatgatcactgtatttcctctgctctcaagggccagagaaatcagatccaggttcacctctccggtgcgcacaatcgtgctgtggtctaaatagtgatgcaggaaatttttatctgcctccggcatgtcaccataccatccgaggaccgtatcattatcatgggttcccgtgtaaaccacacaattttcttcatatttgtgcggcagatacgcactgtcatcccatgccccaaaggcaaattccagtattttcattcccggataaccgatctccttttgcagctctctcacagaatctgtgagaaaaccgagatcctccgcgatgatcttcacatccccgactctctcttttaatgccgtgaaaaattccagccccggccctttttcccatctgcctcctgctgctgtctcggcatctgccggaatgacaaagtattcatcaaagccccggaagtgatccagcctcagcacgtcatataagaggaagttgtggcttaaccgcttcatccaccagtcatatcctgtactcctgtgatactcccagtcatagacaggatttgaccagagctggccgttctccgcaaaagcatccggagggcatcctccctgaactctcggctctccctgttcgtcaagctgaaacatttccggatgtgccagaaaatcggcgccttcctttgccacatagaatggcaggtctccaatgatactgatgccgtttgcattggcatactgtttcagcttcagccactggctcaaaaacttgtactgaacaaagcaaaaatactctctcccttttcccggctgttttaaatccatatatctgcagaagtcatccagccactctttgtggacatgtttgaaatcttcgtagtcttttcctccgcggaagcggctgtatgcgatccagagcaggatctccctggacataaagactctgtcatagtctactttgtcctcgccgtccgcaaactcccagccgtcacattcctcaggagtcagaaggccttctgcctggagctgctctaagtcaatatataagacgcttcccgcaaagcttgaataggataaatatggagagttcccctccccgatcgtacccaaaggcaggatctgccagtaagactggcctgttgatttcagaaagtctacaaactggtaggcttctttagaaaagcacccgatgccgtatgaagacggcaggctgaagataggcagcaaaataccacaagatttcattcaatactccttataactactgatgagggtctcatcatctgattaacagttttcgtatccctcattataacatgatttcctgtggttgtttgcttaaaataacgtacatcgtactatttttgatgattttttataatactgcggatcgttttatacaaaaacggctttaactgctccagtgtgacgggctgtccgaacagaattgcattgtaacagcttccggaaatcaattccacgatcaggtagatcattgtctccggctcctcaaattcccttccggattccttcatcagattcatataagcttcatatatattttcatagtctccgtccatcggttcattgatcgcatttttaaagatgccccatcccagatgtttggagatcagtttcaggagtgtgggattccggtacagctgatcaataatattgtctgccaaaaacacgattttgtcttcaaacagccggatatcagctcgttccagatccctgtaagcctttttaaaaatcagtccggcccggtgtgcgatcagcttataacggatatctgtcttatccttaaaataaagataaaatgtccccttggcaacccctgcctggcttacaatatccgagattgatgtcttctgatagccattttgtgtaaagaggtgatatgccgtgtcaagcagcgctgttttctttctctttttattttcttctactttactcattggcctgtatcccccttttgcttttgcctatgttataacatcattatacttaaaaatgaccataagtcaatatttttcaaaaaaccaaagaatctttcggataattattgacttttagtcatttctatagtataccattaataagaaaaatgacttttggtcattcatttaggaggactgattatgattaaatttggaaaatggattgcaaagcatcggaaattgatcgttctgctttccgttctgctgttgatcccatcactgatcggcatttccaaaaccaggatcaactatgacatcctgagctatctccccaattcactggagacagtcaagggtcaggacattatggtagatgaatttggaaccggggctttctccatggtcgtcgtagaagacgccaaggtaaaagacgtccagaagatcaaacacaaaattgaaaaagtagaccatgtaaaaaaggttctctggtacgacgacctggcagataccacgtttccaaaggaaatgctgccgaaaaagatccggaatgttttctttaacaagaatgcgacaatgatgattgccctgtttgacaacaccacatcatccgacgaaacgatggaggcagtcagtcagatgcgccacgtcgtcggcaaacagtgttttatcagcggcatgtccggcatcgttacggatattaaaaacctggcactggaagaaatgccaatctatgtggtcatcgctgcggtgatgtctctgctcgtattgtgcctcacaatggaatccctgctgacgccggtcctgtttctggcaagcatcggcatcgcgatcctgtataaccttggaagcaatatttttctcggagaaatctcttacataacgaaggcactgacggcgattcttcagctgggtgtgacgatggattattccatcttcctgctccacagctatgaagataacaaggtacggtttgacaacgacaaacaaagagccatggctcatgcaatttccaacacctttaagtctgttgccggaagttccgttacgacgattgcaggtttcgcagccctttgttttatgacctttgccctcggcatgaacatcggtgtggtcatggccaaaggcgtggtcatcggtgtgatctgctgcgtaacgcttctgccgtccctgatcctgatctttgacaaatggatcgacaagacgacacacaaatccatcatcccggatctgtccaacgcttcccactttatcacgaagcattacaaggcagcgattttgatctttctgatccttttgtttcctgccgtttacggaaacaacaacacacagatctactataacattgataaatcactgccccagtctcttccgagcaatgttgcaaataagaagctgagcgacgattttcatatgagcaatatccatatggtcatgctgaaatccggcatgtccgcaaaggaaaagtctcagatgcagaaaaagatcgaacaggtagacggtgtcaaatgggttctcggcatggattctgtagtaggttccgccgttccgaccgatatgattccgggcacgatcagcgaaaacctcatcagtccccattatgagatggagtttatctgttccgactacaaaaccgcaaccgatcaggtcaaccggcagatcgcgaagatcaataccatcgtaaaaagttacagcaaagaatccatggtaatcggggaagccccccttacaaaggatcttgcagacgtaaccaatgtggatctccgcaatgtcaacatcgcttcgatcgcagccatttttatcattattatgatcgtatttaaatcggcatcccttccggttattttggtagccgtcattgaatttgccatctgcgtcaatatggctatcccatattataccggggaggaactgcctttcgtggcaagcattgtcataggcaccattcagctgggcgcaaccgtagattatgcgatcctgatgaccagccgctatcagaaagaacgtatccgcggaaatacaaaacggaaatccatccgcatcgcccacgagacatccatgctttctattattacaagcggactcagcttttttgccgcaacgttcggagtagcgctttactccaagatcgatatgatcagttcgatctgtactctgctcgccagaggagccgtcatcagtacggtcagcgttgtgtgcatccttccggcgatgtttatgatatttgataaattaatttgcaaaacaacctttggcatgggccatattcaggaaataaaggaggactaaacatgaggaaaaagacattgagcagggctttggccatggcagcttcactggttctgtgcgcttcaatggccgcagctccggtatatgcagccgattcccaggaaaaagaggaaactgtctatgtaaaagcagacgctgaaggcaatacacagacagtcattgtcagcgactggctgaaaaacaaaaagaaatcggctgaaatcaaagatgctactgatttaaatgacatcgaaaatgtgaaaggtgacgagacttttcagaaaggcggcaaacacagcatcacctgggatgccaacggcaatgacatctattatcagggaaaaaccgacaaagaacttccggtctccatgcaggtaacttattatctggacggcaaagaaatcagcccgaaggatttggtgggaaagagcggaaaagtccgggtacgctatgagtttacaaaccatgatgtacacaacgggatctatacgccgtttaccatgatcaccgctgtggtactgcccacagaacatttctcaaacgtgaaaatggaaaacgccaaggatatttccgacggcagcaaacacattctcatgggtgtggccttccccggactgtcagacagcctgaagctgaaagacagtgccatcggccaaaaatttgatattccggattcctttgaatttactgcggatgtgaagaatttccagatgacagtaaccgcaactgtggcatctgccgacactctctcagagttcggcctggataaagcggattcgatcgatgaactgaatgattctctgactactctctccaatgcatcagagaaactggtaaatggttccggggaactgctctcaggagtcaaggagttaagagatgcttccaaaactctgaaaaacggcaccgcagtcctcaacaaaaagaccaaagaactgtccaaaggcttaaatactctggacgataaaaaggatgatcttatttccggagccaaaaaactcagcaaaggcaccaaggatctaaaggcagggaccagcgaactggagaagaaaacaaagtctcttccatctatgatgaaggagcttgcctccggtctggaaagtatgaagtctctgaccggcagccttccgagccagcaaaaacttcaggagcttgcttccggcctgaactccattacttcctcttttgagaccatcaaaagcgccaacactcagtacagccaggcacttcagggacagatcgacagccttaccgctatgctcggcagaggaacggttacggatgcctctgacattggtgatattaaaactgcaatcggaaccatgcaggccattcagggcaagatgaaagacgaaaatgacactatcgaccagcagagcaaggctttatcctcttccttagctcccgcaaaggcattgatccagaaactgagcgatccgtccactcaagcatcctttaaaaaattaaacagcctggacaccagagaactgaccactgctgcatccagtctccgttcggcggcagtgaaactgaataaaggcgccggagatctgtcatccgggcagagcagtctggtatccggaaccaaccagctgggacagggaatccacaccgcagcatccgggggcaaaaaattgagttccgcgaccggcacgctggcatccggcggcagcaaactttcctccggtacagatgcactgtacacaggggctgacaccctcaatacgggcctgattcagtttaaccaggacggcataaaacgtctggtaaacatcatggaccatgatgtccaaaacactctggatcggatcaatgacacggtaaaacagggcgataagtatcagacctttacaaaaaaagcaaaaggaacaaaaggcagtgtcaaattcatgatcgagacagaagaaatcgagtaataattgcctcaaaaagagccatggaatggttttaaataccgattccatggctctttttatgcttccgccttttgtaattccagttctttctctctttccttcaattcctttgctatctttataaacagcaggaaggaaacacccagcgacgccaaatccgccacaggctgggcaaatacgattccctcaagtccaaataaataatttgtgatcagcagaaccgggaagaatacaagcccctgccggctcagtgacaggataagggacggaattgcttttcccatcgcctggaacccaaacataaagacgaacatgatgccgataaccgggccggagatcattaagactctcagcattctcacaccgtgggctaccaccgatccgtcgttgataaatgcctggatgatcggctctgtaaacagcagataaagcagtgacagcactgttcccatgatcacattgcatgccatggaaaacttcatcgtcttcttcatcttctccagatttcctgacccgtaacagtatccgatcagaggagcgacacctgagcccagtccgatctgcacgagaatgacaagcatatttgccttcatagctacacccatggccgccaccggaatgtcaccgtaagatgcgagaaaattattcagaataatatttgctgtgctcatcagaatattattgatcgacgcgggtatcccaatggcaaatacccccgaaaggattctttcttttgccgtaaagtgcttcggcgaaattgaaagtcctgtcttcatctttgcaaagaaaaacagataaaacacaaccgtacaaatatttccgatgatagttgcgatggccgcacccgcgactcccatgttcatgcccagaatcatcaccgggtccagcacgatattgacgatggtcccgatcatcattccgatcatggaaatcttggcggctccctctcctctgactacattgttaaaggccatggagattacgacaaagacagatcccagaccgatataggtcagatagctccgcgcgtattcttctgtgttgggactgcatccgatcagtttcagaataaccggcattcctcccagaaagacgatcatcatgatgacgcctgctatgatactgccataaaagcaaaaactgctgatcttctttaccttttctgtctctccctctccaagcatcctggagatataggaacatccgccgatgccaaaaatatttcctaccgccatgagcagcataaataccggcgtcgtcagagacactgccgcaacctggtttgggtctccggtctgtccgacaaaaaaagtgtcggccatattataaaaaatagttacaagcatactcagcactgtgggcagggccagcgtggccaccgctttaggcaccggatatgattcaaataccttattatccattcgtttcttcctccttttatcgtaaatgcagccagctacataatggactctaataaaatttcacgtctgtaataaaaatgaaagcgccgcagggcactttcatctgctgttttctatcttattccaggctttcgagtacttttccgagcaattcacagagtctttgtgactcttcttccgacaatgcttttctgatgcgcatttcttcttctctcaggtggacttccatttcactttttaaatccagccctttctgtgtgagaatcacattgcggcatctcttattctcttcatccacaacacagtataaaaatcctttcgtctccagacgccttaaaataccgatgaccgtggaatgtttcactctcatgaattctccgatatctttctgggttatcttccggttctgatgttctgccagatataaaagcagttccatctgggaataagtcacattcaggcagcgcagtttctgattcatatgctgagtaaacttatcgtggatatgtttaaatctggctccgatttcccgttcctggttcataatccgcctccatatgtagtgcactacatattctacaagactggaccaaaaatttcaaccattaatttatttccggctctctgcctttaccgcatctgcaaccgcactgcaaacccgcttatcgaacactccggggataatataatcctcgtttaattcttcctcagctatgattcccgcgattgcccgggccgccgccatcttcatctcttctgtaatctgagaagctctggcatccaaagccccgcggaaaattccagggaacaccagcacgttattgatctgattcggaaaatccgaacggccggtagctaccaccttcgccccgccttttttcgcctcatccggcataatctcaggcactggatttgccatggcaaatactaccgggtcctttgccatagacgcgaccatctctgatgtgacaatattcggtgcagaaacgccgataaacacgtcttttcccttcataatctcagagagatctcctgtctgtctgtctttatttgttttttccgccatttctttctgtgcatcattcatccatgcttcccccggacacagggcgcctttctggtcaacgagcaccgcgtcttttaccccgaactgaagcagaagcttacagatagaaataccggcagaacccgctccgttgatcactatctttgcatcttccagcttctttcccgcaaatttcagcgcattgatcagccctgctgccacgacaatggctgtcccgtgctgatcgtcatgaaacaccggtatatccagctcttctttcagcctgcgttctatttcaaaacatctcggcgcagagatatcttccagattgatccctccgaatgtaggcgccagattttttactgtctttatgatctcttccgcatctttcgtgtccagacagatcggaaacgcatcgatatcggcaaactctttaaataaaatcgcttttccttccatgaccggcatggccgcctccggtccgatatcaccaaggccgagtactgctgtcccgtcggaaaccacagctaccagatttccttttgcagtgtagcggtacacatcctctttgcagtccctgatctttcggcacggttctgccactccgggtgtataagctgtactcaggtcttctctcgtctcaaccgtcacctttgaccttaccgccacttttcctctgttttcttcgtgcatcttcagcgccaattcattgtaatccatgaccttctcctttatgaatctctttcatctacggttttcttttattatattacagtgtgatataaaataaaataatgtcttcatatctgccgtctgccaagcggtagcccccgggcactgtcccgagccgctgaaatccaagccggtcataaagtctcagcgcaccctgattagacgctaccaccgcattaaactgcagaattttatatcccagctctctcgccctttccatacagtccaaaaccagctgttctccaatatgccgtcctcttgcatctttgctgaccgcataggaggcattggataaatgtccgcacctgcccacattattcggatgcagtatataaagtccaagaatctttccatccgattcagccaccccagtataagactggcctgcaaaaaattcttctgcttcctttaaagaaaaagtatcttcctgcggaaacgcattggcctcctccactacctgattccatatcgctgtcatctcttctaaatcttcttttttaaactgtctcaccgtaagttccatgtacaatccactcctttttctcactcttttgatcccgcagcttttgcataccggtcaaagctgccgcggaagaaagaaaaaagccatcttagagatatctctaaaacggcttgctaagcgggtgatgggaatcgaacccacgtgatcagcttggaaggctggagttctaccattgaactacacccgcatatatgacagagtcttttcaattctctgtaatgcccagagccggaatcgaaccagcgacacgaggattttcagtcctctgctctaccgactgagctatctgggcatgtctcatttctgcgacttctatactttaccatatcataaagcccaaatcaagaacttttttagattttttgtcaccctgcggaattatcctgtctctcttcaaccgcaatgatatttttctcaacagacaaaacaccttccgtctggagttttctcagctccaccatcataccgctcctgtccacacacagataatcggccagatcttttttagaaaaaggaagcttaatccgggatgttttctgcttctcctgttcctggtttatatatgcgagaatcttttcccttgtagtccttttttcaagacactccagcttttgatttaaacgtacattcttttcagccaaaagcacaaccatattttcaatcagcctctggtgaaacgcacagctggcgtcgcaggtcgtcagtaccttatggtaattcaagaacagcaccgtacaatctctggcacattcaaccgatacaggcagctccgcatccggaagacagccataggtctctccgaacacatcacccggcccaatatgggcaagaatcgctctcctcccctcaaaatcatctctgacgatcaggacttctccttccacgatgatccccacttcatccatcctgtctccattcagacagatagtatccctggaagcatacgtttcttttctggctgacagacagcccagcatgccctctaagtcctcctcttttattcctcggaacaggggacaatgagataatatttgctccattttacaactctcctctaaatatgttgatttttcaacagacaactcgtgctcattatagtatgatgagattacaaactcaaggaggaaattaaaaatgatacgacaaataattaaaatagatgaggaaaaatgtaatggatgcggtctctgcgcttctgcctgccacgaaggtgccattcagatgatcggcggaaaagcaaaactgatccgggatgattactgcgacggactcggaaactgccttccaatgtgtccgaccggcgccatctcctttgaagacagggaggccccggactacaacaaagcggcagttcttgaaaaccagagaaagaataatatgagtgcgctgcgccaatggccggtacagatccagctggtgcctgtgaacgccccgtactttgacaacgcccaccttttggttgccgccgactgtaccgcattcgcacacggaaactttcacgaacagtttatgaaacagaaagtcaccttagtcggctgtccaaaactggaccccgtggactactcagaaaagctgacagagatcatccgccaaaacaatttaaagagcatcaccgtcacccggatggaagtcccctgctgcggagggctggaaaatgcggtgcgcactgcccttgaacagagcaaaaaatccattccgctcaatgttatcaccatttctaccgaagggatcatcctggattaagaactttgatttaaaatatccactgcctttccggccagctctctggtaagcccgccttccatgaagcttgtgcggacccagtgttctcccaggctgtactcttcccaatcataatccgtatcatcaagaatcacgaaagaccggatgcgtttcccgcgcatccagtcttttacttccagcgaacggtttcctttatggagatgtttcgtttttgatataatcttcaggccataggaagccatggcctgatccaatgctctccctaccctgatcatcggccctttttcatgccacgcatggcgccagcttgacgacagtacaatctgtgcccccgttctctccacaatatatctcagctgttctaaattatcttcatccacatcaatgcccatgaacggctccatgtctctttcttccagtttatcaaacagttccatagagttcagcacaccgtcgatatctaaaaaaatgatcttttgaggctttacccggaaccgccatttatcaaaggctctcatatgctccatccctttctctttatataactggtaccttttctattatatcaagacgcagcattactttcattcgttttccgggaaattccgggataagtcctgttttattttatcttcactctttttatcccgctgtaacttccaaaatatttctttccatttatcgtcttatatgcccgtacctttatgcagtaatatttttttcgtttcagtcttctcatccaacgcactgttccggcggtagataccgactttgatttagaaaagttttttcctgctgaccagcagatttgataaccgcttggcttgccgggacttttcctgatataaacttttgccttctttttcccggcttttattttcctgatccgtgctttctttggaacaattacaaaatacctattgatctttcctgtataacccccttttcctatgacttccatcctggcttttccgcagtttttatttgcagtatacttcaccgtataatctttgtttaactttaaaacccgattgccgctttttactctgactgtcctgaagattgatttcccggtatatacactgtttttaggctgagagacaaagctgattttttcgtattttttattgttgtcttttctccgtataatctggtaataagaaaaattctgaccatagtaatcattgatcccggtcagacatacacagccaaagccgatgccattgttccccatgtactctatacagtagtctcttccctcttccagatgtcttccattcaggctcaccgatggtttcggcgtgactggttttccctcataatagtaatacctttgcggatagacaacttttgctccggaaacatcattccccttgatccgtatatcaaaagatgtctttatacttccctgaaagcagccgataccttctatcagcacttctgccctgccgggatttttattatttttatactccactgtataatcatttccacgcttcagcacctggccgttatgatttctcacaaccggttccggacgtatttctgcccctgtataaaactgctttgggatatcatctgaattccccagagggccatacacagtcacgcggcactctttcctcacgttccctgcctttactgtaacgaaagcagtccccggtgaaactgcagtaatcctccccagatcgcttaccgttaaaattctatggtcacttcccgaaactatgatcttatccgtggatgaaagaggaaacagcgaaatttccagcaaacggcttacctgtcttccatccttccccatgtccagagaaaccgactcactatccaatatgatatcttcagccggctgctgctccatacctgaaacttggatcactgactccttatcctgctgatcaatataccggtttttctgatttcctaagtcaaactgatttttcagttcctggttttttaaatagattacacttccggaagctaagtcggtaaaagctgccttctttatctccggcagcctgtccccgcataaataaatttggattggcttttcagctttcccgtcgtttccataattaaatgcagaactgctgatcttctgtacactcggcggcaggaacacctgatccagacggcacatatgaaatgcgctgtcttcaatgcagttagtaccgggagaaacagcatagcttaattcttcttttgccgatggataacagaccaatgtcttatcatcaccggaacggccgtacagcacaccgtcttctgaccatagcttcggatttccttcctccacggaaatatctttcagtgaacggttttcataaaactgccctccatttagaaccgtttctcttccaagttttatttcttttaagttatggcagaattcaaacgttcctctcccagccttttttacatgggaaagatctaatcgctgaatgtgggaaccggcaaatgtccacggctctaactctgttaaagaaacaggaattaaaacatcctgtaaattttgattggacgcaaaggcttctttctttattgtccggacgccattcggaatgcggtaagatatcctgtcatctccgcttggaaaggcaatcaggtcagtaccattcttgctgaacagaacattatcttccactttataatatttgtttttatcggacagctggatggagtttaaattggtcatagtaaaagaaaagccggggttgatgtactccaaagtatctgggagaatgagttcctccagatttggatattcatagccgggtactccgtcaggatttataatcacttcttttacaccacttagaattactatcttcttagttatcgcatccgaatgatcataatgaaactttgtaacattgtactttttcccttggtattccaccgacgaaaccacttccattgtatccggctcctgatggtcatacttatagaccaaaacttcattttttgaaataacttcatatgaaaaactgccagctttaaaagtctgcccaataaaactttccccatgaattgtcgttccgcttctaatgctaaaattcacgattacaaataaacaagatactaatataattttaacctcttttttcataacatctccacatgattaatataatgatggtttttagtatcttttctctcataaatatattatagcaaaataagtaaaaaattccatgtattaatttgaaatatacagggaacgactttcgccattccctgtatatttatttctttatttcaaattcatattttaacacagcatcttcctttgttttttccagctgacttgtgagctgagcatttaattcctcgtctttcttccatttgctcgactctttcaaggtatacaaatatttcttatttataaatcttacattatatttatatgagtctttaaaaggattgttctcggcgatatatactatcgaatcaagttttgttttcttccccaaagaatctattgcctgataaacaattttatgctcacctaccgaatttaacttttcaatttgcagcggtattggatcaataacagacactggtactttcaggccttttttgtcatcttctatgtcttctacctgatagttttcaaatatttctttaagaatggtctgtggattgttgtctagatctttttgataaaatgcaagattctgtgaatgtaatttgggaggattgttataagttacacataccgtgccttctttttctgcaacatttccaacgctgtcttcagcttgaaaagtaactttgacttctactgtctcatctttttcaagcttcataaaataagtgtccattacatctgtatcattcattcctccagaaaaattttgggtttccggccggtatcctttcatactttttgcgtaatctagttttataatctgtactttttttgtcaattctccatcttcttcatcataacaaccctttacaacttttaataaatcattcttctttattttttcattctctaaaaaagtctttttatcgttcaaaataatatctggtttactgtcccattggccttccataaaaaatatatcttcaacatccaataagctatttatattatccaaattttcagatgaattgacttttttattgctttctgcaaagtctaatatatgatttaatttacccttttcccgctcttcttttaattctttatatcccaccggttctaattccattcttttgcgggcactgctgatatcctgtttccagcctacaaacttcccttctgatgaccggaacccgtttttcctcagcagtatatcctcagatttgttttgttcctggctgtccgtcgtgccagcggcactccgaattccaggcagatactccactctgtaatggggccaaagagcaaaaagagtcgcatccgcatttgccgtataaacattccccggctgatacccgtctcctgtcccatctgctttcgtattccatgccacaaacgcgcccgacccactggcaggtgtcagcgccgacagccttatgtcctcctcccaatacttaactgctgccgtcggcatgttcatgacctcctcttttgaatttttatcatagcgaatctgatatgcctgactcagaacaatgctgaatggagcacagccagaagatgatttctttaaatttcccggtctcatgacatatccgctgcctgcatacacaaatcttccgcccgcagactgattattcagcaatgcctctcctgtcttgtaattaccgtccgcagaatttgatacattcccttttactaccgcatagccgtttcgtatattggcagtatccagagaaattttggccttcaatgaattgctgttggaaaagtatcggttggaagccgtaacaaaccggtcctttgcaagataaatttcctgttgtatctccgtatttccttctattgaaaacagacttccttgatgaaaaataccccgttgtgtaccatttttgcaatgattgttcaagatatgggcgttgttgttcagaaccgtaatatttctgttataaatacctgagccatttccggacgcactgtttccctggatgtttactgcctgattcgcctgaaacgttgtaaaagtaccgctggctatgtaaacagctcctccgtctccggaggattgatttccagtaaagctgctcccgtttgccttgcaggtgccgtcaatgtaaatacccccgcctcccgcctttgcggtgtttccgctgacattgccgctgcttaaattacatgtgccggatgaacttactgagatacctccgcccttcccggaagcgctgttagaacttaccgatgcgtttgaaagtgagactgttccgtctatctgaagtcccccaccattggcagaggcggaattgcctttgatacttcctccgcttacagaacctccggcagtttttaaaatggctcctcccccgtatgtggcggctgtattggcagatatctctcctccggtcatagaaagttttccctttgcatagattccgcccccggaattgccggaatgattatttcttacagttcctccactcatgcggaattctgcctcgtgatagatgcctgcgccatattttgccgagttatcatacatagttcctccgcttaaagagcctttcacagaatccgcacagtaaaaacctcctccataacctttgctttcatttccgtgaatcacggctcccatctttagttccaaagcggcgccctttttataactgccgtttgacagacagatgcctgctccgtttccggtgctgtgatttccattaatgctgcagtcttggatggctccgtttgaaccgttgttcaaacatatggctccgcctgcatcggcctgattgttttttaataccacacccgtggtggttacctgctgatatccatcttttccattcacaatccatgcagcggatctcctgtacttccagacgcccaagtcaccttttgtagagcttacttttccatccgtttcgatcgctccctgcactttaaccgctcctccgagagcatccttcttttggttggacgctgcacagtctgaaatcgcacctccgtacagtctcagggttccatagttcataatgcctccgccatgaatcgcctgacagtgttctattgatcccgcaaacatgtaaaaagaagaaccattgccgaccaggacacctcctccgtgagaagatttcggtgaaccggaagatacgtctttgctgctctttgcccggcagttgtcgatcctgccgccaaacatataacaggatgtaccggaattcagtgcaattcctgcccctcccgcaaagtccgccaaaaaatatccgtctatgatacggctgtatttatttagatacaggtgccctgatgtaacttctatcaaaggagctgacgcagcgatattttttccgttgatgtacagattattttttgctcttccatctccgtcataagcccctaatgtgagtgatcctccatttacttccaacatgacatctttatatcctgcagtcctgttgagattatgtccgctctcaccgtccgcgtaaatcttcacatgccggccgttcgtcctgatcactgatgtcacattaaaacccttgtccacacggacggctattttctcacctttctttacggaagccacagcatctttcaaagctttcaaagaactcacggctttaaagttggaatatccgtctgaaacagcttttgccgccgcttttttctgtacctggactgactgccgggatacttctgctgagtttgctggaaccctatctttcttgagaaagccaagttctttatagaaatcatccactgcgctctcaatttccagtttcccgtccttcaccagtttcagggcgttgtaaaattccaaataatgatccttttttcctgaaaccagctgttttatatattgctctgaagaatgataatctgttccctcaatctgatttatacactctatgacgatctcatcatccggcttctcctgatttcccttcttcagtatcaaaaaataaggctgcagccggtcaaaaaattgttccagctcctcctttgaacgttcgctttttataagttcccttgtaatctgacagtttgtcacttccaaaaacacagactgctgctgcggacttaacccgtcataaaatttattctgttcttcttgagtcccggaggtgaatacatcgatgtatccaccctcaagcagttttcccataaagctcgtctctgtgccggcctgaacgaccgaagccactgtgcctgtgccctgttctgatcccgatatcgcagctgccgtcagcaggcttgctgcaatcacaccggaaatgattctttttccccattttttcattctgacatgcccccttatgcttcttcctgaaactgttccagcactgctgtttttctgacctcgatcgtttttttctttccgtctgaagtaaggaaggtctcacggacattgacgtccagcaggccgtggatatggtcggctccgataatctccacttctatgtcggcatctgatgtaatctgtgtctttaaatcccggacaaatatctctgccatctgctctctggattcatactgttcctccttcatattgtccaaagtctgttcaaccgcattggagacatccatcgtaagttctgtttttctggttgtgaggcctgcaatattttgtgttataaacacagagtagattaagatgacaagtaaaataattcctgtgactgcccctttcataatggctcctcctctgctttatgccccgccgtgtcatcccagcagaataaacgagctgtttgcacctgacttctcaaaaaatgttgaaatggtatccgtcagcgctttttgaaactgcgtcacaaaagtacctttggcaaaaacacataaagccagcactacgatcaccgctacaataatcaatccgtaatcttctaaaaaacttttcataaataactcctttcagtcattcttcatcctctgttacactgttcgcatagcttctgatctgacaaaccttttctatccgcagcagaggtacatataatttatacttcaatgttacaagagagcgggccctgttctcatcagcctgttcctttaatacatccaaagaaacatacccgtcctcctttgcctccttccggcactgctccaccactgcttttgaaaaacctgccgcatccatcttatggactgcggccgactggtactgctttgcgttggagaccaccttcgtattggcacaataaacgacatttaaaaacattcctgcggctataataaaacagcatacaaatgtctctacagccagcttcattttttatcctcctcataatgcatacccttcaatctcctgccggctggcaattcccagcagttttatcctcagatgataagccagcactactttatactttggcttatcatcataaaagccgtcattttttatggaaagactgtatcctttttcagacgcctctttttcacactctttaatagtcaaagggtcaaaaccactggcctcaattctccctatcatatcctcatgaacagctctcgctccggcctcctccagtgccgctccgttatatgaagccattataaaggcaccgaggcagagcagaatcacactgacgactaattcgacaggcatcttcataaacattcccctttcttcttaatcgccaggcagacgatccatgcggaaataaaagtaatacagacggtaaaacaaacatgattcagactgatccaaagaatcggtgaaaaagacagcatattgctgatcatatgtactaaaaaaggtgcttttaagctttgatttttttcatacacaaaacaaaagacattcccccacagtgatgcatagattccctggatcacctgtctgtgacacagcccaaaaataacgctggaaatcagagacgactttacttttcccattggttttagtccttcatacaagaatctgcggaataaaagttcctcggctgccggtccaacaatccctgccgcagctgcgtttactaagatcgggcttttctcagcctcttgattcattataaatttgctgttatgaaaaatatcagttagataaacagagatgtactgcgtgaggaaaaagaaagatattgtaaataagatcagctctctgcggactatgaatcctttcttttgatcctttgccaaaaaggggctgcaaagaaggatcaggcacaggccgctgatcagatttggatacagaccgggaattccgatcaggctgcacagctgtccgcagattctgtaaattgtataatatataaggaaccgcttcacatcttcattcactgtgattttcaccataattctttaccagtatcttaattcttccttccgaaactaaccctatggagtttttaaccgtatataaaagaatgaattctttatcatgactcgtatccagatattctgactcaaacagagatctcacttctttccctccctcattcgtgacaacaaaaatcttgatcttttctgttaagtcaccgtcttttttatcctctgcctttacaagctctctcggattcagcttttcttcttttctaatgacaagtctttttgccgtgccgtcttccccacggactccagacaactttggtctgccctgcttttgaaaaaattcattggatgagatatgattggtatcctgtatcacgccgtttgctttcagctgtgaatagactgtatttcgtatgaggaaaactgctccaaaagctgctgctaataacacaataatccttccgtaattctcaatggtctgcttcacctcatcctcctaacacaatgcgcagctgatagagtcaaaaaaggccgttccaaaccgggcagcagcagataatagtactcccagaaacgcaagcaccgcggttcccgcgatcacacacaagatgatgctgccgtattcgtcaatgattgtcttcataggtgtcacctcctttcagctgatcagctgaacaaaatgaatgtagactgcacaaataccaatgcctgtaagcagcaaaaataaaaccgctcccagttcctcaaaaaaatcctgcatatatcctcctgtctattacggaagcttcgtccaaagcgtaaagaaacttccaaaaatcaatcccaggtccatgatcatcttgaaagttgccagtatcatgggcacaaacgtcaacgctcctatccctgctacatcattctcattttgaagccattctgccttgtccatcaatacattattccggtgaatcaaggtattgatctgtgcctcggaatcgtctttcccacagttggtaagggaatacagcattctggaggcagactgtatttccggcagatcaaactccgacagaaaattctgatacggcagtatagattcgggatcttcatcaatgttacgaagaagtatctctatctgttcctttaatacataaggtgcctgatcaagagaatcccttatcgcaacatagacattttctgtctgaaggctcagtgcgatccccctgagccaatatggaaacttctgattgatctcttttagaattcttcccccggcattctttctctttaacgacggcgtgaaccacgctgcggctatcagggctgttaccgcccctataatataaagattctgccagtcaaaccccaggagtaaaacgggaaaactcagtatagtaatgatccacggctgttttccgtccttttcctcccgcattgtcttaaaatcttttttgatttgttccggattttcatccagtgtatctttcagccacgagcctgtgagcagtttttgtgctcccagatataacatcagaaataaaaccaaaagagaaaacgtcgttctctgatagagcggtcccctgagcacctttccaagcatctcatcgctggccagcatcataactgtggtccccgcgactgccagagatgcggttagagatagtacgatcttaaatttcatgctttttctctctttctgaaagagatatgtccgctctgtccattctttcacatcgtctaatatgatatttaatgtactttggtactgaccgcccagattttccaccttgaccagatagtcatgcagcatcttcatccggtcacagcggtactcctgctcgatacaggatagtgcgtgccggtataaatcgtccactgcacccggactgctgatggctttttctgcctcatcgataagctccaggatacggccttcacaaagctgttttgtctcctccaatgccacaatgatcttaggctgttttttgaaagaatacatcatttgctccaaataattcaccacatccctgaatctctgctgttcatacatatatttaaactgccggatgataataatcggaaaaaaacacagatatgccagacccaggcctatgatataaggtatttgcagatgaaaaaattttcctgctaaaagaattccaaggaaagataaaagtaaagatgcgagatattttttaaatgaataagagtatccatagccacgaatctctttttttagatttgtatatttgatgtaccgaaatgttgtcagaattgttcgtttatgatgttgtctcatggttcactcccctcccatcggaacggatctttgaccaaaaatttcttctttaatttctccggaagttctttatttataatcctccggtcctttaagatcaactgtattgttttctgtccggtcttgtccagatagaaacaggcaatctgatcaatgtaacggcgaattctgccatccggactctgttccttccgtatcaggatccccaagtcaacgaatccatagacgtccctctctatacgttccgatgcgataggatcatccaccatatttttcatcctctccggtatccttcgcacatcatctgtgtgaacggttgtcagcgaatagtgtcccgtggtaagggactgtattaaatgctgtacttcctcgcccctggcttccgacagaagaatccacgtaggcagctgtcttaaagatgctttaatggcatctacatagccaaaagtatcttcattgacctcaatggccacacagtcttttcccggattaatctcccggtaatgaatctctaagctgtcctcaatcgtgataactctctccatgtccggaataaacctggtcagatatttcaaaagttctgttttgccgctgcctacctgacctgcaatcacaatattcatatgtcccagaatgcagtttttcaggaaattcaggatttctctgccgcagtaattctctttaaaaattttatcttcgctgagccttacaagtgccggtgactttctgatagaaatactccgcccggtggcacatacatcttcatgtataatggaaatcctcagtccatctacttctgcttccaccaaaggatcatatttattaaacggagcagagactgcattggctattcttgcgctgaactggctgataaaactttctgaaatctctgttccagcaacagtatgcctgccccgctccaggtcgtcaacgatcagctcttttccgttccagttaacgtcggtgaccatatcgtcctgaatgaaaggcagcagcggcccaaaatacctgtcttcgattgcaaatttctgcatagttcctcctgatcaatggaaatggggttgtcttgaaatagatgtagaagtgattggctgtattttgatataagatatcttatttccatattttaacttatatttatctttttgtcaatccgttaattgtttttttcatacagcaaaaaaatagtaaaaagtaaaaaatatagttgacatctctgccctgatattgtagaataaattttgttctcagcaaagaacttcagataatatgcgatagtagtacagttggtagtacgcaaccttgccaaggttgaggtcgcgggttcgagtcccgtctatcgctctttttttaatttcagaaagtctagtgtttgtaaaggttactagcagtttaaacagcaaagataactgctgtcaaaaagttgggtggccttttcggtaaaaaatgacgatagttttttataaaactaccgccatttttatttttataagataatttttaatattatttattcacaattttatttttctgtctataattcctttatccagtatacacatgtctgctccattgactttaccttagcaacccttgtgatacttgtttagatttatcaaaacctgatccaatagaaattcccggtgtacccgtaattgatatggaacccccggtaacttttataattctatgagcataatttgagatagcttttgtggaataatttttaaatgttccttgatataatctaaatcttgcatatgctgaatatattgttccctttgaatacttttgtggaaatgtatatataatacctttatttggtttttcatctttggatggtgtcttattaacaaatatatatctgcttttagacggattataatatctatatgttgattcaacctttttcgtagttatatttaatcctcctccccaggcacatgctattcgatctgaggaagcaacaaacataggatcagatttccactgataatgtactaaaatttcataatcagcattttttctttttccttttacctttttactgttatcatatttgaccatagaggtagccattttttttgcacttatacttccagaagccgaacatttatttttataatctatatctttaaaaccatctatatttttactattgttgacttttactgcgttttgcaacatttttgcatctgttgtagagcatttatattcctccgaaatcacttctatagtctttgattctatttctttaatttcctgtttgacattctgagcctcttccagagacatcccactattttgaagttcctctattgttgcttcagagagttttctgatttcacccacttcatctaattcacttagattatatgttatttccactgcctgtcgattcgttctcaacatttgttccacttcttcttgctgatcttgagtaaacgtttctaagcctttctgttcttcttctgttaaattatatttgtgtgatatactttgagtaaaattctgattatctgtttgtttctcgtcagtatttgcccatattatatcattcatactcaatacatagattaataaaattgctgcaataaataactctttttttataatctttatcataacagtttctccttattctaatttctttacttccaaccacagtaatctaggttcataacggaaatactttgtcagaaatggatttttcttgtacataagactgtatagtaatttcccatctccatttttaactctgtcatactcttccttcatacacctaactttctcctttgttgtcttaatctccaaatagtactttccttcttgtttcactttctgaatctcatttgtaaaacaggctgtagaaatggttctttcactgttactaactttgtaatatagaatacccattaaaattaccaatgttaaaattaaccatttacttcttttcatttttcacctccttttcatcttttctgatgccttatcaacgttaagtatatttatatcaatcccctccttttttttattttctaaactataggaatacttgataataatatcctttatttcatcattacttatttttgaatcaatactttttaaaagcgcaaatgctcctgatacataagctgttgcagctgatgttccgtcgacaaaagtacgatcacccttcccaatttccacctcaatattttcgccaggagcatatatatcaattatcttcccatatcccgaagcattatataattcccctttactatttattgcgccaactgatataatattttttagctggtaacatgccggatatattgggtatttatctaaattgacccctgcttttcctcctgcacaaacaaaaactgcatctgaatactttttcatttttttataaattgccttattgttagcttcaaaatcaaagctacaattaaaaattcttgctcctctattgtatgcatagtctatagcttccgggatatcctcaagattcccatctgctccatgcaaaattttaacaggtagtattgttatccctggagccacaccaaaatatgaatctttctgatgcgatccagcaagaatatttgcaatatatgttccatgtgcatcagaaatataatcatcatatactgtattatttttatgataaaaatcccaccctgatatatcgtcaatatatccattatgatcattatctcgcccgtcaagtttttcatttttatttttatagatggatttttttatattcggatctgttttatcaattcctgtatctaaaacagcaacaattatgtttttaactccttttgtttttttccatgttttttgaatatttatatcaattccctgtttgcccttttttccattaacaatttgtccagagttataaattgcccactgtttattataatttttgttccttacatttttttgagaactacaagccattaaagaaaaacacagtgtaaataaaaggatagcctttatattcatcaatttatatatcaaaacttttttcatttacagctcctttttaatctccaattttttgaatggttttaaccatttggtaaaaatattctatcataaactacaagaatagtcaatattattataatagttattattatttatatagttaaaaattaaactataaatattgaagaagggctgctctatatgtatttttttaattatctatttattgctttaaagttttttgcatacctttttttaatttctggccaaatggtcaaaacttgttaatttgactgccaccaaaaacccaatatcctccgactcatcatataatgacaagccctaaaatgttgatctttcagccttttctttaaatagtcatctttcaaaagattgaatggatactttccaccgcatttgttgtacacatgatcttccgtaccgcgctcccatattcgtattttcctctgcattcattgctctcgtaacctaaataatccttcatttcttctttcaacatggcttcaaacaaaaaatagagtatgcagttcctttagaacttacacactctattttgtactccctaataaaaggattctcacttttctgtcccactgactatgattgcgcatactgccttctttccagttcttttattatctcactcatagctgttactcatttttatgaataattttattttgcaatacacccaataatggactcctctatatatgaaaaaggtaaccgaaggtaccttttttcatatatctttgaaatttagtcaatgctttgttattctttcgattccgagtacatttgaaatcgcttcctgcaataatctggaataatttattccagctttatctgcttctacactcatccaatatggaatagtacaatttttctttactgccttattatctacttttttctatactctaaaaaatcaacgtctactaatgttacaatatctcctggtacaatttcaggactgatcgtattgggctccggaagttcttttccttcatcttccatatcagttcctattaatccaatagcgtctctcgccatttccattgcatctgcaatggtttctccctgagtacccgtatcaaaatcagggattgatacatagtatccatcatctgtcctctttaagacaattgggtaagccattttttgtttcatcatttcctccttttatttatacgtatcttgtgcgtatgctattgatttccacttctatcatagtgttggacacttttcagccatgcctaaaaattttcttatctttgatcattatttttatgccatattgagacagtgaattatttttcagaattgcttgacaattatattccctcatgttattataaacaagtattttgataagattttgattttcacatattttttgtaaatcattaccacttcttgatgatttacaaaaaatatgtgatttttttatttttgcttcaaatacaataaaaatattaggaggtaccacatgaataacggtacagtaaaatggtttaacagcactaaaggatttggatttatcacaaacgaaagcacaggagaagatgtattcgtacatttttcaggaattgctgcagaaggttttaaatctttagaagacggacagaaagttacatttgagacaactcagggtaaccgcggattacaggctgtcaacgtttgtcttgcataatagctttgatcattctgaaaagatgcccagcacaacgctgagcatctttttttattaattttggaaacactgatttcttttgttatgacattttgttctgcagcggtcgcgtcatacagttgctggtgtcttccctgcagaggattaatctgctcttacaatatcaatgatctggtcgaagggcacagcaaatccttcttcatctctcaccatatggagaatatcatcttcttcactgtaacgtgcaaactccacaagcatgaaagtccccgtcaccgtttcatccacagttgtcaccttaactttgtccccctgggagataaaaacgtcttcttttacttctccgtcctcttttacaattttcacgcccggcagcagacttgtaatttccataatacattcctccataaaaattattatattagtaagtattataccctactgcgccggacgcgccaagtccaaagggcataaaatacaacgtgtccggtattcaaaagtctttgttatcctcctctgccgcttccttttttctggcctcatcaaatatttttttcattcgtctgttcagtctctccgtgggcttatcttccggtatcaatgaagggtccaatgcaccttggcgatcatgttcgtctgtacttttactgtctgttttcccatatcccatgctctccctccttcttatattctcattttatcaccagcgatgcgcatcagttgctggtaatttatggtaattgcatgccgatattctattttattcttacatatagttgaatatgcaactaatttatgctatattatatttatctaagatagtattttgattcatctatgttcaaagtactaatttttttggcccaaaatagttgtgtattcaactttattcgaaaaaggagacttttatgaaaaaaatcagcagactgatctctgttatccaccgtcacggaatgagattctttgactggtccctggctgacacagagatcggtccgggacagcagttctttctcgtgtgcatttatgaaaatccgggaatcagcatgcagaaactggccagcatcggtcatttcgataagggtaccgtcacaaaagccgtaaaaaaaatggaagatcagggatatctgagacgggagccggacgcctgtgataagagaatccagcacttgttcacaaccagtgaggcaagacctgctctccaaatgatttatgatctgcggggacagtggaacgaagtactcttagagaatcttaccgaggaagaagtccaacaggcagaaaccctgcttacaaaaatttcagacaatgcatattcatatatacagaacaggaggttgaaatcatttggaaacacagacaaataagaaagaaaatccattgggatatgaaccggtcggaaagctgctgctccaatttgcagtaccttccacgatctctgtcctggtaaactctgtctataatatcgtagaccagattttcatcgggcagggagtgggttaccttggaaatgcggccacaacggttacatttcctatcattacgatcatcatggcattcgccactctgctcgggtccggcggaagtgcttatgcggcaatcaagctgggacagaaaaaagaagaggaagccgagaaaacattaaacaataactttatgctctccattatcactggaatcgtgctggccgtgatcggctttatttttatggaaccgatccttcgtttattcggagcaacagagagtatcatgccctacgcaaaggattacgcgtctatcatcctgatcggtgttccattcagtgtcatcggaccgtgtctctctaatatggcaaggacagacggcagtccccgcctttccatgtatggaatcctgatcggggcggtattgaataccattcttgatccaatttatatttttatctttcattggggtgtcaaaggcgcggccatagcaacaattacatcacagatcatctccgcactgatcctgtttctctacttctgcaaacggagccagatgagactgcatctaaaagaattaaagctggatggctctgtctgcaaaaatgtgatcgcactgggcacttcctcaggcatcacccagctggtagcctgcatcatgcaggttacgatgaataactctctcgtatattacggaaacaaaagtgccgtgggcggggatgttgcattgagtgccatggggatcgtcatgaagcttgccatgatcctggcatctgtttgtatcggcattggtatcggctcccagacgatcttcggatttaatttcggggcagaaaaatatcgccgcatcaaacatctgtttaaaaatgcggtggcggcggctactgtttccgtactgatcggatggctgttatgccagctgtttccgggattgatcgtaaatttattcgggggaggaaattccgcatttgtgaatttcgctgagaaatgtctgaggatttatctgttcggtattttctgcgctggatttcagatcgtggccacaaactattttcaggctacggggcagcctctcaaggcgtctgtcctctctatgctccgccagcttctgcttctggttcccctgattttgatcctgccgctctttttggggcttaacggaatcctctttgccggacccatcgcagatatgtcatcggccgtgatcgtggccctctttgtcgttccggagataaaaaaactgaatcggcatataaaagaaaaagatgaggaaaccgaagaaatggaaaccagtcctgcataatagcaaggatttactcacaaaaagaacgggtatacgcactgtaaaatgtgtgtatacccgtttttagttttgcccctgactgtatataagtcttatcctgaaatatgccgttgaccggaatcgaaccggtacgggagtataagtcccgcaggattttaagtcctgtgcgtctgccagttccgccacaacggctgatggtgggagaaggattcgaaccttcgaaggcgttgccaacagatttacagtctgccccctttggccactcgggaatcccaccgcgttcctgacaatttaaaattatactgtatgaaatatgaaaatgcaagtattttttgagaattccgatgaatcccattgttttttccgcctttttcctttaaaatatttcgtggctatactacaaatttaggagaaaagaaagtatgaatacaaaaaaacaaaaaaagaaattatccctgaccgtgatgatcctgacagctctattcttaggtatcctgtccggtcttctgcttcagggccatccgaagatcgctgagaattacattcagccgttcgggactatttttctgaatctgatcaaaatgatcgtcgtccctgtggtcctgttctctatcatccagggggtcgtctctctccaggacatcaaaaaggtaggttccatcggaggaaaaaccatctgcttttacatcgttaccaccgcatttgcggttacatttggcctgctgttcgcaaatgtactgaacgtaggcggcggctatgtaatgaacagctcctctctggaggcatatgaaggcgctaccaaggctccttctcttatcgaaacccttgtaaatatctttccgtcaaacgcagtcgagcctttagtcagcgccacaatgctccaggtcattgtcatcgcactgtttttcggattcggcatcatcattgccggtgacaagggaaaacccgcggcagaccttgtggagagtctttccgaagtctgcatcaacattatgggcctcatcatcaacctttcgccgattggcgtgttcgcactgatcactccggtcgtggccgcaaatggtccgtccgtactgcttcctcttctgaaattgatcggagtggcctatctggccagcatcgtgcatatggttgtagtttattccagcgcggtcaaaggattcagcggcatcagcccgctcagattctttaaggaacagagcccggccatgctatttgcgttttccagtgccagcagtgtgggcactctgccgtttaactatgaatgtacagaaaaacttggtgccagaaaagagatcgcaagcttcgtcctgccgcttggcgctacgatcaatatggacggtaccgcaatctaccagggagtcagcgctattttcattgcccagatcttcggtgtacatctgacattaacccagcagctgatggtcattctgacgacgaccctggcttccataggaaccgccggagttccggggtccggggtcatcatgcttgccatggtgcttcagagtgtcgggcttcctttagagggaatcgccctcgtagccggagtcgaccgtatcctcgatatggcgagaaccaccgtcaacatcaccggggatgcagcctgcacgatctgcgtagatgccatggaaaaacggaaagaagcgcggagaaaactaaacatatccaataacctgtaagttatttaccactatttcgtcacgctttgaaatgcgttcctccaatagtgctaaaaactatcattggatagcttcttttgttctaggaatacttgtccaacagacatcatgtggaaaatgtcataaaaaaactgtcgcactaaaaaggtgcggcagttttttgcacgaaatccacgaaatatcttctggagaaggctaatgaatatagaaatcttacattgaatagcccatttaatcgaataatacttctccagcagacattatgtccatttttcacatgattggagtgaggcattctaagagccgaacggaaatcatgtggaaaatgtcacgcttctgtaccttcaaacaaggtttcaaattcactctgattgattcgttctttttccaacagcagttttgcacagctgtggagcacttccatatgctcctcgatgatcgctctggctttcttatagcagtcatccacgatgtcttttacttcctcatcgatgatagtcgccacccgctctccgtacggacggggctggccgatttcttttccgaggaagacttcatccccttctccgctgtcataattgatcaggccgagacggtctgacatgccgtactctgtgaccatagaccttgcaagctgggtaacctgcttgatatcctgggaggcaccggtcgtgatatcttcaaagatcagctcttctgcgattcttcctccgaggcttaccatgatattgtgcagcattttatttttcgtgttaaagatattgtcgttttcaggaagcggcatcgtatatcccgccgcgccaacgccggtcggtatgatggaaaccgtatagaccggtcccatatccggaagcacgtggaacaggattgcatggcctgcctcgtggtaagccgtaatcctccgctcgctctcagggacaacacggctctttttctctgtgccgatgcccaccttgataaaggatttgtcaatgtcttctttcacaatgtatccccgattatttttagccgcctggatggccgcttcgttcatcaggttttccagatctgcgcccacgaatcccgctgtcgttctggcgatctcgtggagatccacatcatcgcccaatggcttcttcttagcatggatcttaaggatatcttctcttcctttgacatccggacgtcccacgccgactttccggtcaaatctgcccggacggagaatcgccgggtcaaggatatccacacggttcgtagctgcgatgacaataatgccttcattgacaccgaaaccgtccatttccacaagcatctggtttaaggtctgttccctctcgtcatggccgccgcccagtccggaacctctccgtcttgccaccgcgtcgatctcgtcaataaaaataatacatggcgcgttcttctttgcctctccaaacaggtctctgaccctggcagccccgacaccgacaaacatctcaacgaaatcagaacctgaaatgctgaaaaacggaacattggcctctccggcaacggcttttgctatcagtgtcttaccggttcccggaggtcctactaagaggacacctttcgggattcttgccccgatgccgataaacttcttgggatcttttaagaaatccaccacttcttccagttcttctttttcctcggtaagacccgccacatcgtcaaatgtaactttggggccgtccggatttgccatcttggcacggctctttccgaaatccatcatttttccgccgccgccattctgcttcatcatcatgatcaggaaaaatacaaggattcccaccatcaaaaggttcggcagcagggtcgtgatccagtccccgctccggtcgatcggcttcactaccatttttttgtagagattcggatatttattctcgatctcttttaccgccgcgtcaacgtcggtaatattacagtttttatacacttcattttttaactctaccgtcatagtgccggttgggacctctttgttctgcttcatggtgattcccacaacctgccccgcttttgcgtcctgacggaactgtgcgtaattataattgtcctcgctgctgttcatcattctggaaaaataaataatccccagacataagatgactgcaaggaacaaaaaattgctgtttcctcttcttgggttcaacttactgtctcctctctgctattcttctgcgactccgatatatggaagattcctgtaattctgagcaaaatccaggccatagcccacgacaaactcatccggcacgtcaaatcctgtgtatgccacttccacatccacctcccggcgctccggtttatttaaaagggtgcagatctttatgcttttaggttttctgctcaaaagcattggctttaagtggttcagtgtttttccggaatcaatgatatcttccacgatcagaacttccttatcctcgatcggttcatccagatccttggcaatctttacgataccggaagactctctggaatctccgtagctggacacggacataaaatcaatcgtaacagggactgtgatcctcttggcgagctcacatgcaaaaaagacgccgccttttaagatcgcgatcaaatgtacttctttccccgcataatctttgctgatctgagctcccatctccttgattctcttatccacagcttcctctgagatcaactctctaatctctgcttgttccattttaatgttttcctcctaattgtattccaatcttaaatatcttttcgttttttcagaaaccttataaaactcgctcaggcggtgaccgatgatccatatgatccggcttccgtctgccgcaagcggtatccggtcccgctcttcccgcgggattttctggtcaataaaaaaccggctcagagacttactctttccatcttttgaaaatacaaaaaaatctcctgactttctgtaccgcagttggatgtctttgtctattttatcataatcaatgattttggtaaaatctttttcctccattttttcataccggtccgtctcggtcaggaccagctgtcccgcagtccctgtttctgctcttgtctgcttttcctccaccaagagtcccccgtatgtttttctcccaataagtccatatggaagatcgatggatttcccggtttccctgaaagccagatcacagaaactctggatatggaccttctcaatatccttttttctccctgcggcctgttctatggcctgttttgccaaaagcctcctgatcggctccggttcctccagaaaccggccagtatcgatgagacgtccctttccttcctgctttacacaggctttccatgcctcagacagctgctcttctaaataccggctccactcttcgatttcttcagacaatgaaacgatatgttccaccgcccttgcattgacttttgtgagcgccggaataacctgattacggatcttattcctggcaaacgtattatcttcattactggcgtcctccatccagtcttggtccttttcttttaaataagcaagaatttcctctttcttaaggcacaatagcggccggatcacatctgcccggacggcttccatccctttcagtccctgtattccggtccccctggacatccggtaaagcatcgtctccgcctggtcattctggtgatgagccactgcaatctttccgcctccgtgcatatccagaactttcctaaaacaccggtagcggatcatccgccctgcctcttccagagacatagattgtttttcagctgtgcctttcacatcttctgaaaaagttatccacggcaccttccgtctccggcataagttttccacaaattcctggtctttgaacgcttccctgcggataccgtgattgatatggactgcgcagagctcaagatcatactcctgcttaagctcacataaaagcaggagcaggcacacagagtctgctcccccggagactcccacagcgataaagtctccctgaccgatcatatgatgtttttccataaactttcgtactttatccatatcaatactttatcattcccaatccaaggattcaatacttatcccaaattccgagaccgatcatcgtcatgtcatcctttttttcgtatccctcggttttttcgattttctccatcagttcatccacaaacccctggggccgtgtggtatggatctgcttcatatactccatcagcagttccactcctttttcgcccatggagtcaatgatgccgtcgctgacctgtaaaatgaaatcttccgcctccagcttcttccggtgtatcggcagtgtcttttcctttaaaacacctaccggcaggcttggaagctgcaccatctccacctgtcccttccgcttaaggaaacacgggcaggcacccaatttgagaaaactaccgattccggcgtgcagatcgatctgcagataatcaagggtcgaatagcgctccttctccggccagaacacaaaaatagactgcagaagctggacggctcttttctcgtccaatcccacctccaaaagttcctccagtgtctcgatcaccgctttgctgtctctgtttgcagcggttcctgtgcccatgccgtcggagatcatagagacaaacctgtgatttcccacagtacccatagaaaaattatccccatttttcatatcttctttctccgccctggagatcacccctgtcagcacatgaaatttggtcgccgcctgcacccccatcatctcatagttctccccgatggcctgcttaccgttgggcagcggctgaagtttttcctgtaaaatgaccgacagccagcgggctacctctttggtcgttacttcccttcccttctgggcttttaaaaacaggtatatctgctttcccctcatgtcatcttcatagatgtaaacctttttcactttcagatgatgggctttcagccccttctcaataacttcctgcatggggcggactccggacagctgatatttctgggccgagaagcttttaaacatccttcccgcctctatgtactgttccccgatcatcctgcgcatttcgataaaacgctgttcacaggcatacaaaaaaagctctctttcatagatcgtattgatctcttccacccactccttctcccgctggcatttgcagacagagcggatattctgcacgctgaggcctccctgcttctccagaagttcccccagcttgtccctgtcgtcgagagtcagccggcacttatctttttcccggcacagcatacattcttttaaaatcgtgctctctatgatcgttcttccggtctttttttccaagtcttcatcctgctttgcacacatccgctttccgatcgtagtgaggcagtgctccatctgtttcatattatatgatatgatatcttccagctcattgaaaaatatctcttctactggttcttttttctttataatcggcatcctggaccctccttcagcttctaattatacaagggtcttgtgtcataatttgctgaaacggatctaaggaaccgatttccatacaaacagctcttgttatttctctttgggacagctaaaataaatttaaagtattgattggaggtaacgaatggagcatgcagacgaaatgatccctatcttaaagtcgtcccttcctttttgggagcacctgaaagaaacagaaaaaaagactctctcccagtggtctcagcttatacgctacgaaaaaggagggattatccggtgccagaactgtgaatgtaccggcgtgctgatcatcaaaagcggaagtgtgcggacttacatgctctcagaagaagggaaggagattactctgtaccgtctggagcagggagatgtctgtgtcctttctgcttcctgcgtactgtctgccattacttttgaagtacagatggaggcggtaacagaaagtgagatcatacagatcagcgcaggtgcttattccgaaattgttgaccggaatatttatgccgaagcctttacctataaacaggctaccgagcgtttttctgatgtgatgtggaccatgcagcagattttgttcatgagtttcgatcagaggcttgcaatttttcttctggatgagagcggaaaaacaggttctgacgacattcatatgacccatgaacagctcgccaaatacaccggaagcgccagagaggttgtgagccgtatgctgaaatacttttcatcggaagggctggtaaaactgtccagaggcggagtcacgatccttgataaaaagggattaaaacagctgatcagctgaaataaaatgcagcaaacggacagatgccgttttgctgcattttattgcttagataaaaagatttacatcggaattttccgcgtctcccaaataggaggccactcctgcgaactccacaccgtcaatgatctcttcttttctgatgcccatcacatccatggacatggtacaggccaccagcttcacaccattttccatggcctgcttcatgaggttttcaagagtttccacatttttctctctcatgacccgcttcatcatctttgttcccatgccgcccatattcattttggacagtttaagcttcctgcttcctctcggcatcatagctccgaacatcttctccacagctgatttttttacatgctgtttttccggcttcctcagaatattcagcccccagaaggtaaaaaacatggtgaccggcctgcccatagctgcggcaccgttggcgataataaaggaggcgagggccttatccatatctccgctgaacacgaccatcgtcttgccctgaccgctgattacgtcagtggctgccgcacacagttgctgcccttcttttcctttttttataaagactacattttgttttccgtcccgctccttcttgactaacgtatttcctgtcctctggcaccaggactcaatatccctcggaaatcccatgtctgtggctgctactttgactgtctcgccatcctccatggattctaaggtctcgtgaaccttcatgatcggccccggacactgaaggccgcagcagtcaacaagccttacttcttttggctctgcctctgctgctttcagctgctcttcttcccggcaggcagatggccggctgtctttgtaatgcatagactgataaaaactcgttcctccttccagcacctttacatctgaaaaaccattctgcataagaattctggctgcgttgtaggaacggactccaatggcacagtaagtcacgatcatccggtccttcggcagctcagacattctctgtctcagctgccccagcggaatgtgaacggagcccggaatatggaacaccatccgctccatctcttcggttacatccaaaatggttaagtccttctcccatccttctgtttcaatcctgtcatccagttcccggcagctcatgaaagagaccatcttctccaaaacattctctgccgtaaagccaagcatatttaccggatctttcgctgaagaataaggaggggcataggcaagttccagctcttccagatcatagatcgtatttccagaacgcatggcgcctgcaagcacgtcgattcgtttatccacaccttcctgccctactgcctgtgcgccaagaatatttccatccaggtcaaacaacagctttaacgtaaccggaacagcaccagggtaatatcccgcatgggatttctgattgatcagtacagtttcatagtccttcccccggaccttccccttacggatcagcgtcttttcattaaccccggctgccccagctgtcaggtcaaatacctgagcaactgaagtcccaagagtccctttgtatttcttctgtccccctgcaatattatccgcacaaattcttccctgcttgttggccggtccggctaaaggaatcattgctggttctttcaatacatagttttcaacctctatgacatcgcctactgcatatatattctcttcggaagtccggagcatctcatcaaccagaataccgcctctgccgttaagttttagacctgcttcccccgcaagttcgctgtttggacgcactccgatggacagcaggaccatatctgtctgtaattccttcccactgttcagtgtgatcaacgttttcccgtctttatgttcaaaagatgccacgccgtctcccagtatcaggctgacaccgttcatttctatgttttcatgaagaagctgggccatctcgaaatccagaggagccatgacctggtcctgcatctccacgatactcacctcaaggcctgccctgtgaagattttctgccatctcaaggccgatgaatccgccgccgattaccgctgctgtcttcggcttttttgtctctatgactttctttatcctgtctgtgtccggaaccgtccaaagagtataaatatccggtccgtcaatacccgggatcggaggcacgaccggagaagatcctgtggcgatcaccagataatcgtagttctcctcatacactctgcccgcctttaaatcttttatggtcactatatgatcttccgggttaattttcacggcttcattctgcaccctgacatctacgttaaatttctttttcatggcctccggagtctgaagaagcagagactccctgtttttgatcacatcgcccacatgatacggaagcccgcagttggcataggaaatatattcaccccgttccagaagcacaatttccatactctcatcttttctccgaagacgggccgctgtcgtcgcgccgcctgccacaccgccgatgatcactgtttttttcctcatattttccacctcatatttttttaaatatcatatctgaaatgcagtgattactctgtgaccatgtcacacaggaaaatattattcatatctgaagtcgtatacatctttatggatatccagtgttttcccattaatttttattttggaatcagacagccatttcatgtcggcatcttcacagtgatattcaaaataaatatttttcttttttgagttctgtttatcctcgatctcaacgatcactgaaaaatcgaccgttgtattgtcttgtccgtggtaggcattggcggtgtatctgccgcttggggattctatactttttatcaattcccctttagggacggactgagtatccagtgtaaagtgatagactgcccatccaaaaagaaaaagaggcagtatgcctaataatatactgcccctgaaaaacgatttctttttcattcatactcctctaaaacctctaattcacgactgtatccttttctcttacaatattccatcaaagttatgctccccttcaggtccggttcatttttatcaaaattttttatggttatatttttgtcagccccttttttcagataatattttaaaagcttttcttttgaaacatttatataattgtttctgtcatacagaatataaaacaatatattggctccatgcttgtcccgaaaattcacatctgccccatatttaataagtaggtctgacattttataaacatcttctgattttgggagtgttaccgtcagttctaacggtgactgttccactgaatctacaaactgattcaactctgcacccttcttcaaatgttcttccaccctgtcatagtcacagatcatgatatcgtataccagtgtgtgctccttgccgtcatacccgatcatcacattacttgcctgatcgttgtcgagaaaatcatcgtaatccctctgaagcattatataaatagaaatatacatacccgccatacaaaccaatacgataagcagaatgattattaatgttttccagaggttcttatatctcatgatatgtttcttattcctccaaactcatgttgtactcctgaggatcttttttcagcagaaatttcttgtgattcactgtctgattcctttgaaatctgctgccctctgacaactttgtatccacggttaaataggcttgtccctcatgatgttttatatctaagttcacatctattttggttttataccaattatttaatttaagatataaaatctttaacgtcccctgaaattctaaactttttgaatccagcggaatcataatcgcatattctccatagtccgcatttccatcttttaatgtaaaaccatcatggtaagaccactgcgcattcttatccgtttgtctgatctttattcggcttgtcttattttttgtccctgtgatatcctccgcactataattgacagccacttttacatagggacggttccattgatagattcctataaccgctaaaactatacacagtaagacgcaccacattctatgccctttaggcttggcgtgcttcacacgattatgtatcattgaaccaagtattattttttttcatttattcctcattgtcaatatcttttttactcttcttcctctgtatcataagatttataattgcaaataccataatcgctgtaattagaaagtcacccaaaattccttccctcaactcaggaaagaatttgttgaatataaaaagtcccattcctaagaaaaacaaaatatacttcatttctccctcccattttaacttctcttttatcattataaattttgtacaccctgctgttgttgataaaacattatttttttcttatattcttcttgcgaattcaaaatctaatattatactatttctttagatataaaaatattgttataaaaagacttattactagaatataatttaagactccacccattaaattcggaaaaaatgagagtataaacaacataacacctaaagtcaacaatacatatttcattttattctccattcaaaataatttttacaactactataattcctagtgatttatccgtaacttttttgcttttttcataatttattatttagcgaacgtatgaataaacttaaataagctcaatccattttaaaatcacatcactgacaatcacaattaacatcatcacagtaagaaaaattattccactattcttctcttctttgtcttttgtttttactattgcataaaaaccaataccaattaaaattacaaattctatgattccaacaaactgttttaaagaaactgataatttaaaatgatcatcaataaagtctgtgaccgcgtaaataccacaagttaagagcaaatacaaacaccatttaaagtgatgctttatcaatttgtagtctccattgatccacaaaataaaaacatcgtgaatgatatgtgcaaaaatataaacagctaagagcagtaatatttttatgttcattttatctcccgtaattttttagttaatcagttatctaacccaaatctttcttattatgggcccgccatagcgaagctctggttttaaaatagcactttttgatatttttccttccatccaatttacttttaaaataacctcaggaatatcgacacctccaaattcccatactagataatatttctccttattttcattaataaatcgatcttttgttattgaatcgccttttccattaactcttgattttattttacctccgtatttatgagtatcaccgttgtaatttatttttacatctatgacaccgatatctccagtattatttccttcataatataaatctccagtccaatctcccccttcataaacaatgtatccatacaatctccatttcccatcattgctttccgcataacaatatgggtattgtcttaaatcctgtatatgtattgctccacataatccccaaaatagaataattccgataacaatgtatcgcttttttatcatatatttgctccactgagtttaatttaaagtaatgctttcaattttttgttttttactaacttcccattataatcaaaaaccagtaaacttcttttcataagatttaattttttattcgaaacataatttaaatctattactacataatcattacaataattaacgtcagcataatactcattgtatttaatagaatctttcacctcatcattttctgaaaatgatattattttttgtttatctcctgtataaacatttaaacaataaaaatctaaattttcattattataatacaaatagtctttttcaattttagcttttcgatttaatagctctttttctttttttatatttttaactaagtatttcttatgtttcgttttcttattgtataaaacaatatttgcttcatctatgctcaaaaaatattgtggatctacatacccaatccaaagtggttcctcttttgccggacatcttacaattgttttattcttttcatttatttcaagcagctcttttgaaaatctattccaactataaataaaaccattgtcaaaacgtaatacattggacaaattctctttcaatatggtttttgtcttcccattttttaaattctttttatacagaaaattttgttcttctttataggttgtctcttgattctttaaataataaatattgtttgacgaaacagtatatagccctgcctgatctaatattttttgacccattccaatatcccgcagttttttcgagtataattcaatacccgggccttcaccagaaacattgtaaaacactttattgttatggactgcaagcatatcaccataagtataaaatggacgaacatagttactaatcaagtattccctgtcttttccaatatcatataagtacagtcgttctccaaaaacaaatgggaaatttctgatggaattctttttgcgaaccaagacgtaatttgtttttgaatacgactcagacatattggtgtattctgctgtatgatgaaaattaattctagctttctgaataaaaaacaaacacaaattaaagattccgaaaatagtgcatataatcgctgctatttttaatatacttttcattgcacactcttcctctatatacaaggtctatataaaaatataatgatcctcattcaccttaatttttcttattttaaagcccgttggataatctttaaacccttcgactgatgaccgatactttttcattatgattcttgcctttttccaactgctaaaataacctatcaatttaatatctccgtcgtggttatgtgttaactgatatatatacatattgaaacccctcctattcatctgtaaaaaatccctctgcccaaaaactattttcaacatttaactcatgttcacttataaacaatgcttctctcttacctttaaatctaggctgttctgcaaatttctctaatcctttctgagcaagttcatatgcagaatatactgcgataaaagtctcatcatcattttcaggattttcatcccaatagtaaaatgtcaattcataaattgtccttcctatcacccaccttcatttgactctattctccttcttgttttcatcccccttaacataaatcctcatcagtgataaaaccttctttccactctggttcatttaatttgtactcatcaatataaaactcattttcatgtgtaataaatctgagatgcttcttaaacttttctctcgcctcttcagccagtttcaatgaagaatacactgctattgttatttcatcctcatcatcattttcttcatcctgataccaaaaacttagttcataaacattcatattctttacctttttgtatttactaacctaaatgcagtttgctcctcacctgaaatgtttttgttcttctgatagtgataaacttaatatgacttcatttttcttttttacaagccttcctcatttttttaattatacagtatataacaaataaaattgcactaataaaaattaggcaaacaattaatgacatggcttgaataaaaacatcaactataagctccctatcaaaatttactatttgagtattacaaatttcttgatacaagattatgacctccgccttattaataatttcattctcactaaaaaaactgaaagttgcctttatgtatatagtaaaataatcttcaattcttcataaaaccctctaaaatcatgtttataagaattctaaatttcaaatacatcccgcttttttcgttatttctttgcgttctcttcctttagaattttctttatggatatctcctccatgtctttttaaatatgtaaatcttaatatagttctattatatcaagtacctaatggataataataattattcaatatactctacagcataagtatgacatttaatataatagaagccataacacacctaaactagctatgttatggcttataaaaacatatctttaaagtttagtacattatctcatgaaaatcagttttcactttttaaataattgatattccacgtgtatcccgcctcttccgcaatttgcttacaatctttcccattggaatcctttttattaatatctcctccattctttttcaaatactcaattatcttaatgctctctcttccacatgccatattcattgatgtacatgaaaatttttctgtctcatctttcacatacttatttatttctgcaccgttcttaacgagatatcttaccatagaaaaatcaccaatgttgattgattcctgaagcaatacgtttttcctgattttcccttgcgtcattccatcttccataatctcctttgctaagtcgctgcctccaatccaaattaatgtttttaaattctcctctgaggcctttaagcctcttttacataattcctgagctttataagttgaatttaagcatacactgtccaataagttatctccttcttccttaactttaattgaatagtgatgatctaatagatatctgaaagtttcatcattcacttgttcataggcatgatacaattcaatatcagttggtacataccccaattcattcatagttgcaaaagatttttgatttccaaatgcagtaataaactgccatgaaactacctctccatcctccttatttttttcataattcacattcccatcctcctttaacaatctggcattttctaattgccctccaagaactgcaaaggagatagcatctgctttatagtaatcagtcctgccatttccatctaaaccttcctgcaacagatatttcacaacatttgaatcattacatagagctgctatttgtaaacaattcacaccatctttatctttccaagaaaaatcgtaaccaacttctttcataatacttaatgtatcgacattacagtaggccacagcaaatgctaaaaaactatttttgtttaaatgttttttggatttgttttcttttaaatacttttgtaccttcttgtcatctccttttactgcatatagaacttcttttggtatattaggatccactttgttcttctgcattaattttaagatctctggtgcgaaataataattcattccataatcattatgttgataaaaatatgtaaatagctcccgatccattttcacaccatgatttgaaagctgtgcaattattttttttctctttgtgtagttattaggggataatttacttagtgcggcccttataggagaatccccttcatcacttttttgatttacatcagcctctgcttttatcagttcctctgctatcttatatctatcattttcaatagcccaacacaaatgagaaagtttatcttctccaatctcatttacatctgctcctgccttgattagcatggagcagatttgtaattggatgcgctcattttctatttctctcaaagacagatccagcggcttcaacttgcgatgacgtttaatattcttattagaaatcttcttatcattcgtcaaagcttcctttacaccttggatatttggtctacaaatagatgcatacaactgttcttttgccgtatctgtttgcttattacatccagttatacaactaataattaaacttaaaataaatatcatccaaccctttttcaatattagcctaccgtcctttccatgaaaatgtcctcctcgttaatgacccttttacattcagacttttcaccttagccaattttttagataaatccctcatttgactcctgtattttccacttgaaggaaaccacaatgtacctgtcatttttaacgtagtttttccccatgtcttcttttttggtaaatatggtctaggagtaaatcctgttaaccaccatgcttttccttggtcagtcgatgttttactatcacgtgtaaataattttttcccatttgcatataaagacattctcattcttaaccttttgttcgagtcatatgcacaattccagtgtttgctccaggttgattttctatagtataaaccaatctcacatccatttgctaccgctggtacatatggtggcccatatatacctttccaaaactgtaaacgccaatgtgaagtctcaatcttccttgtagtcaagtcacctacagcccaagaattcatatcataaaaatcattatatcctgcatacttttgcggcgcattttgattaaatgcatagtaatgttgttttgaactccaatatcctaaaaacttatgtccgctaggatccacataattcacaggattatccgcacaatacgcatacaaatgctgtgtatccggctcgtttgtctccccacgataagtatcctcagacaaaaaccttccgtcctccggattgtaataccgtgcattcagataataaaaccccgtcgtctcatcatatcgtccgccagtataacaagtctcatttccggatgtgttttctccaacactggttgtttctccaaagtcttcatagcggtaagaaacatccgcttttccatcgtctttcagaagattggtcgtactgccctgaacatccttgttatacacatagtatgcagcatcattgcctgtatacctctgggttcctataatatttccgtctgttcccaaaagatcctgagacgtctgatctccttttccattggtcgtataagagaccactccatcctgataatagtagttggtcgtctgatctccttccactctctggattctctgcccgtctccattatagcggttctgctgcacaatggcatttttgccatctttgttgacagaaacttcggtcagccggttctccgcatcataagtacggtaaaggatctctccggttttactattggtctgtccgatctcatttccattcttgtcataggcatactgcttgttttcctgagctgtgccgtctttccaggttgtagaagttgtcacctgatccagaccattatagtcataggtcgtcttcgtatcccctttctcctcggccagtcgatttccaaccttatcgtaggtataggtcacagtctgtttgctgtcgtctttcctatggtctgttgtaactgtcttttcaagtcttcccagagaatcataggtatagtgtttcgtctcattgaccttttcttcatccttttgaggatagttgtttatctgtgtcttctcgatgatgttggaattcttatcataggagtaggcataagactccaccaccgtatccggatgttccagatctgtgtagaccatctttgacacacggtcaaaagtatcataggtatatacttttttgactgccttatcaccgtctgataagaggtttcggtaatctttgatctctgttacttttccgtaatcatcgtaagcataggtccggaccgttgcttctttcgcatcacttcctttatatacatccgctttgatcacagacaaccagccgtcactggtgtaatgataagaaaggcttctgaccccatcttttttcgttggatagataactttcgtaagtttgccttctgcgtcataagcatatttgatcgcatgactcctgatctcatccgccgttggtttttctgactggctcagttctgcataagttgtctttctttgaagcccgtcatactcacactctgtataacggtaagctgtttctgtgtttccgctgacctggtagtccaccatttcgatgagctggtcatttccgtcatagctgtaagaagtcttgagagtcctcgtacctgattcgcttcctgcctcaggtgattcataggtgttggtttcggtcagacggttctttttgtcataatgatacgtcttataggccccgttttcataagtttctttcgtcttatttccatttgtatcataagtaaacttagtggaaatgctctcgcccaggtttcctttgctcgtcgtggtttctgtcagcccggctgcattggtcacttcgatgttttcatgacccatggcatccgtgatgcttgtggtattcaccccgtctgttcccattgtataggatatggaagtgctgttatccccctgggatactttggtcacccggttttggtcatcgtaagtgtacgccaccgtgtttccgtttccgtctgtcttggctgtctcatttcccttgtcatcataggatgtctgattgacaatggacttctccggatcaatggaaacatcctcacccgcaatcacaggattctggacggtatgtgtctgtttcccgtttttgtcatacaggtttaacgtaatctttcctttgacatctgctccgtcttttgttccgagaagaatggatgctgtctccttgccgtcttctgtaaatacatggtccgtataaatgccattgcttttctcccggacggtatttccggaaccgtcggtatacgtctctccctggacctttccgttcacggttgttgtgacgacagaaagattctgatagcttttcattccggagagtgtatggatctccctgtcagcatatccatagtctgtctttgtagttttcgtgatgccgtcctttgatacttcgacagcctcttctacccggttattttcgtcgtaggtgtaagaagtggtaactcctgtgtctgaagtctctaatttcaatgtaccgttggcattgtattccttttcctctgtctttacgactccgttcagttctttttggatcttgacctgccgtcccaggaaatcgtactcagtggtcgttatctcggttgtgtttacatcctggcttttggtttctcttcccatcgggtcaaggaccgtagtagattcctcttttacatttccctgggtgacggtgctgtcttctgtgatgatatggtctttttcatcatagtgcgtctcttctctggatgtgagttccccttcttcatagtcctcttctaaaataaggtcgccgtcttcatcatagtcgcatacagtttttgtctctgcgatggaatcagtctctttgatcgtatttccactcttatcataggaataggacacatcagaaacagttttatcaccctgctttgtcacttctgtcttgggaagattggcttccgcgcctgttccgtaagtggtctgcgtcacctgcccggtctcgtccttctccatcgtgacattttcattggagtcatactgtgtctttgtggtcacttcttctgatgtgaaattcactttgccggagtctgtgaccatctgatgatatactttggttgttgttcctgtgcaaagcaggtcattagaagcgtcttcatactggtaagaggttttgtttcctgctgcattgacagatgtcagaacttttccattggacttatcataggtaatggaatcttctgaaatcttttcatcctctgctttatggagagaaactgtcgttttgccgtccccataggtaagcttctgatattctccattaggcttctttacgttcactgcccgattattttcatatgtgatgtcatatgaattgtctttggcgtcttttacgtctttggcgtcttttattgcatttaagaagctctttgcatcgtaaccatattcatatgcaaccgatttacttccgtcagcactgctgtgtacagcttttaccagattgcttccggagtaagtatactccatcttcgttccatccggcaggacaatttcctttaacaggtctgcattattttcctcaccgtcaaaatatttcatggtgagtgttttgattttattcgatgtaacagttttcagccggcctttgctgtcatattcgtagagaatgaaattatcatttggctctttcactgcagtcagctgaccattgttgttaaattgataaatcgtgttatccttagctgtaatagtacatgcataagaaataagttttgttacagtcttttgttccgtctgtccttcggatgagccggaagatacattgtggctggcttcataactgcatccttttaatgttgtatgacttaaaattccggattctatagtaaatgattcgctcaaatactgatttgctgccttcatgtttggactctgagaaacactttttgctgcagccacattatcaaagctcagtttataatctttgctctccttggaaacataggaatctccctgcttttcaaatgtaacataagtaccgtcgctgtcctgaaatacaagattcgcccctacctgataaagctccttatgataactgtcataccagccgtttccgagcattcccgctttgtcagactgactgttgtaagttctcgtaagtcccatgctgagctgtcccgcaggaatcgcataatcttctgcctggtaattcaggtttcctccggctttatctacggttccatttccgttcggtgtactgaattccatggtttccctgtaatctttggaacccagccactgttcatattcggatttggcatactgctttttatggcctgctgtcacgtaatcacttgatccgatcacgtttccttttttcgataatttaacagtccggactttatagtaataatcctttccgtcaccaaccctggtatcggcacaataagaatcctttaccgccgctctcaccagattggaagcatccggcgtaaaatcagcgctctccccgcggtatatctcataataaatgcttcccggaaggcttgcttttttgtcccatgagatcatgtttttcccataaagattattcagtttcgcattgaccggtttataatcagccgcctgggagttgtcaatataataataactccttgaagtctcggcggtataccctgccttgtctgtgaccttcatggtaatctgataggtgcctgcatctttaaaattagacgccggtatggaaacctgaccgctcactgcacttcccgcattgacatagcttccgtttcctaccttatactctactttggacaaatatttttctgtaacattccattttagtgctggggacatattggaagacggattttcttcagaaccaccttttccatcaccggcatcaatggtcatgctgttgatcttcggggcagtgctgtccacatagaaaatatatcctttgccggtaccgttaatccctccgttgtccacaccgcggataacaaacttataacatccctccggccagttcttactgtctgctactgatgcgcttccgcttcctgtggtcccaagctttgtgcttccagaataagcgcggtagttggcattcacctctgcattttttgccgggtcataggtggcaactctgtattccgccctgtttaaagacttggaactgatgcctgcccacttagcggtcagtgtctgccctttcttcatgtactgcggagtcacagaaacggaagtaggagttgtcggtccatcatagtaagtcacactcatcttcggccggtaacttgcgttagaatatctggaactataaaactgcccatacttctttgtctcatctgcatttttcagcataacgccgtaggaagtgatggagccgttcgcacattctctggcatacttggtcagattgatgctccttgctttatgggtggttcccgttgtcttcacacttccatagtttgtggaatatccgggacggttactccatgtaagtccgggtcttgaccagttagaagtgactctccttgcctcaatcgtctggccgcttgtactgtcaccggtttcatacatggtcagagtggcagtatccacgtacttattcttaatctttgccgtgaaatccttaaacctcagatatgtacgatatgttcctttgctggcttttcccgccatcattgccgttacgccggaatcataaaagttggtgtttttgtagcttccgttgatcacgtacacatcccagaagtctgttgatcctttccatgtgaccgtgggatcaatcgtaatcgggtatttgcggtctttgtctttcagatactcctcatccagtgtcagtgtcagttcataggtatctttttcgtccttgatcggttcaatatcataggataatttttcactgtatgcttctttcgtgtcgtcgttcattgacggtgcttccagtgaagcaatgatgtcttcactttctttgtcatagaacgtgatacctccgtctccgatgtttttctttgccgtcagatttttggcataaaaccggaacttcagctgattgctgtccgggatctcttttaatgtgacactttctttcactcccgcgtccagtgactggtataaaaacgtacagtttttatcctctgactcgtatgccacactgaccggcaattcttcttttttgtcttctgccgtcaggacttcctctctctggagttttgtccttttcagcttgttaatagaagagaaggcattctcctctattttttctttctgccggtcctgtgtctcaatgccgctttcttcttctcctgtgattggagcaaaagagatttcatacttatcatgctccattaaaaccggcgtggattccgtcagtttcttgggcagatactgctttttatctccgtctttgttttcatattggtaatctttcagattatgtccatgctcgctggtcttgtcttgaatctccacaagggtcggatcataatctttcaagtttccattttcatcttcataccttacatcctgtccgtaaaatacagattccttttttccgttggacaggcggaatgtggttgaattttttgtgctctcactatcaataacttcttttgattgtgctgcttttggctctgctgcttttacatctcctgatccggcaatcataccgctccattgaacagatgtaaacatcaaaacaaaggacagagccgcacagactgctggctttaccaatttcttcattataactcttctccttttatccagttgtactgtctgttataataaagacgtccatgtgatacgttatctgcatttgcagatgtctggtttggccgccatttgtattgcatggatctttattataaacgccttcttatgtgtcgtttctattgcaggtcatgtctgtttcttcttcggcatcaccacctttccatttatctcatcactaccgccggtaatttcctttgacagtaatggttttgccggatttattctcaacaaatactctgtattttcctgactcggtaattgtaaaaattttatttacagtattggttgcttttatatatttttttatactattgttttttttaattccaatcttaacattttttactgttggtccaatctttacagagatagatatcgtacttccggctgatttgctgaaatccttcgtctgtttcaatacattgtttccaactgaccaatttaaggcataagccgttgaatatgtaggcattaatatttcatctactgtttctactgtcacctccggatcatcctccatagaaatatactctgtctctccgtcgatctcctcagctgatactttgaccggcactaaaatcatagtgcaaagaattatcagtaatgtacttttataaatcttatttctcatacctgctcctccatctccttgtgaatttccctgtgaaaacatacttactttgaggaagattttgtcttgtgcattaagctatagactcctaccacctgcagttttttatctgctttgttttctacaaatattctgtaatccccctctttatttactgcaaatatgtgctcaaaatctcttgcatccgatacatatctttgcgtgccatcgggttcgatgattcctataagaatttcatcattcttgacttttgttccctcgtcctctgaagtcatcatcaaaatctggatcttctctccttcttgtactctaaactttctgctcattgagaattcctgtgatttcggccaccagtcaattaatatatcttcctccttgccaggcacctctcctttcatttctttctgtcttacatcagaaactgccgccctttttttctccttcattatgataggcgggtccatctcttcctctattttcacactggtcttatcttccaaaaatatatatcccctataatatccataagatatcgcagtgatcgtcgccgctcccaaagtacaaaaacagagaaaaaatatttgtgcgcttttccacggcactcccttcatcttcctgatagaggcggttctccgcatccgcagttccagtcctctgctgttttcataaagtgcagaggccagatactgacggtatccgctttttcttgcggcaatcgaaataatcgttccaaaatattgcttcaggcttccaaacaccttcagtacccggacatcacaggatacttcactccaatcctccacctggctgcagatctgctttttcaggggattaaaccagtgaacacacgccaggacattgcacatcagtttccaaaaaatatccctctgtttataatgttccatctcatgaagaagaataatctcaagttcctgttttgtgtaatgttcctccggcaatataatcttaggtctgaccactccgcagatgaacggcacgggaacctggtagctttggtaaacattgattcttcgccgtacacacagtttttttctgcactcatccgcaattttctgagtctgcctgctgcaaatacaggaattctcaagtgatttcctaagacgcctgtatttcaaaaaataaaagcaccccgaaactgtggctcctgcaagccagatcacgcctatgatctctgtaatgtctctgatcactgttgtagtagaaaacaaataagatttatgtgagagatcttcaaatataatagaaagtacaggaacaaaaaatacaacaacaattatttttaagatcgtataatttaattttgcatctcctttcttctccaagtatctgctgattggcttccagtaaaaaaacaagacgcttcctgtcactgaacacaagaaaatacctgaaaatacccggatcagaattttagtcatctcccagctcatctaataccctcctctctaatcatctctttctgcttctgtaataagttcatagtctcctgccagctggatcttctttgttgtctgattttctacaaaaaactggtattctccgctttcctttatcaaaaaactgtgctgcagataatctttatcacagacaaatttctgcgttccgtccggctctataatccctgcaagaatttcattatttttaacctttggattatcatcttcagaacatagcagcatcatctggatcctgttccctttttctgctcggaattttttactcatcaagaattctttcgcctccggccaccagtcaatccatatatctttttctttacccggcaccgcatctttcatgattctctgctttgacaatgatgttcctgctctttttttctccttcattatcttgggcggatctgccttttcttctatcttgatgcaggtcttatcttctaaatagagataccctttaaaatacccatacgatattacagaaatggttgctgctcccagagtacaaaaacagatgaaaaatatctgtgcgcttttccacgggattcccttcatcttcctgatagaggcggttctcctcatccgcagctccagccccctggtgttttcataaagtgcagaggccagatactggcggtatccgctttttcttgcagcgatcgaaatgatagtcccaaaatactgctttaggcttctatataccttcagtacccggacatcgcaggatacttcactccaatcctcgatctgactgcaaatttctttttttaccggattaaaccagtgaacacaggccagaacattgcacatcagcttccaaaatatatccttctgtttataatgttccagttcatggagcaggatgatctcaagttcctttcccgtaaactgctcttcagggagtatgattttaggtctgatcactccgcagataaatggcactggtgcctgatagctttgaaaaacatgtatttttcgtcttacagacattttctttctgcagatttctgcaactttttgcgtttgcctgctgcaaatagaggcattgttcaaagcggccttcaggcgcctgtgtttagataaataaaaaactcctgaaacaatggcccccaaaagccagatactccccacaatctctgtgattgttctaattgtacttgtagtcgaaaacagccaggttttatgtgaaagatcttcaaatactacagaaagtacaggaacgaaaaatgaaacaacaatgatctttaagatcgtataatttaattttgcgtctccttttttctctaagtatctgctgactggcttccaataaagaaataaaacacttcctgtcaccgaacacaaaaaaatccctgaaaacacccggacaaggatttcagtcatctcccagctcatctaatacccccataagatgatccactgaatcttcggtcacttcttttgtcaatgcactcatcatcctttgacttgacccgtcaaaccagaaatccagcatctttgctgtctcggtctttttatactcatcttccccggacaacaccttaatataggaatgtctccccctcctttcgagcgttataaatccttttccctccatatccacaagaaatgtacggagcgtagaatgttttgcatcccagccgaattcttctctcagcctttcctgcatctccataaccgacaattctttttctgaaccccatgcacacttcataatcaatatttccctgtttgtcaaatctttttctctcataactaaattctcctttgttattcatttaatattttagcataattatagcacagcagaaacggaattacaagaaacctaatagactaatcgcggttttcgtaagaatttattaaaaaaacctcatcctataatagaatgaggtttacggctgtctctaaagccactttttcaattgtcctaatattttatcataatcgatcttgctgtaatcggtcacgtctacttcgatgagtttccccaggcagaattctccgtatccccggtttctgcaccggtccatgaaaatatcataatccacaaagcagtcgcctttcgtcctgtccagaagcacatcccctttgtgataacggctcaccacatggcctaaatggcggcttgtgtccagatctctctgctttgaccgcccgaaaaggacttccagatcacccaccaggcggatcgtaacaggctgatatccgtattcttcacagagtctcttaagctttcctctctgcttttcgctgaaaggataatcagataccagccgtttcccttgattcatggcatcttctatctgctcatagtaaagcgtccagcttttattctccagagccgtcttttcttccatgttgtcaaagccaaattcgtcccaaagctgttccttcatgtcatcctgggaaatcacctgaaaatccttctcctgctccaaaatcttattgcacatataagtctttccggtgcccggataccccgccagtaaaatcaatgtctttttcatctctcctgctcctttagctttcgttccgtcagatccagagacggtatggaactctgtcctcccagactttccaccgagatcgcagaagccatggaactcagctttaaaatatcttcaagagacatctttcttgccagtccgtaggcaaatgccccgtgaaagatatccccggcaccactcgtatcaacggccctggcaggataggcgggaagatgtttcagttccccgtcctcttcatacagcagtcccttttctccgagagtgatcaccgcatgcttccggttgatgctctgaatctgactgaatatctctctgcacagtccggggtcattcagatccatggccttccctgtatactgtctggcaaaatcttcggaacagacaatataatccacatatggcgccacctccatagtgctctcacggcaggtccccgcatccagtacagacagtgccgacggatattcctcaatagcaccgatgctgagtttcggaagatgtccgtcgcttaagatcacactcacatcaagtttgggataggtatactgccggtaccgtatttctcccgggaaattaaagatggtcctggctccgtttcctgtattggaaaggatgatgctgtaaggcgtctctatcccgtcttcctccacgagatgggccgtatcgactccagcttctctcaggatttttttaagcttctttccataatcatcgtccccgatacggctgatgagactggtttcctctccccacagggcacagagataagccgcattcatggcagggcctcccccgcattccagccggtctctgacacggtacttctgattctctgtcagctccccatcgtatgggattacaatatcataggcagactgccctacacagactactgccataggctattcctccttcatgatcttgatcagcctgctggttccgagacggtctgcccccagtgaaagaaagcgttccgcgtcgtcaaaagaggcgatcccgcctgcggctttgatctttacaccctctcccacgtgttttttaaacagctccacatcctcaaacgtggcgccgcccgtggaaaatcccgtagatgtcttgatgaagtcagcccctgcgtctgtcactgcccggcacatacggatcttttcctcttccgtcagcagacaggtctctacgatcactttcagaatcctgtcgccgcaggctttctttaaaagacgaatttcttctataattttatcgtccctgccttcttttatatctcccagatttacgaccatgtcgatctcatctgcaccgtttacaagggcattctttgtctcaaattcctttactgcactggtagaataaccgttgggaaagccgatgaccgtacaaagcttcatcttatcccccacgtattctttggctcttttaataaaagacggcggaatacagacggaagctgtcccgtaggcaatggcatcgtcacagatcaccctgatctcctcccatacggccgtctgtgcaagcagtgtgtgatcaacagtttttaagatttcatttctctccataacaaggctccttctctctgaaactaaagcggctgtttgactggtttcttactttctattgtaacagataaaaccgggaaagtaagatgcgttttcccggttttatcttctgcctcttagattctgaataaagatgctttctcttttacaacatctgcaatcttgtcatttgcaggcccgagaagatttctcagtgaagtcagaggagtcacatcctccccggtaaaggtttccctcaccacttcgatataggatttgttaagttctgttccaacattgatctttttcattccctctctgacgcagcgcctcatatcttcgtcagacactccggtacctccgtggaggaccagaccggtatccccaagtttcgctttcagctcggtcagcagttcatagttgatctttgccttggatttgtactgcccgtgggttgtcccgatggaaacagccagtgcgtccaccccggtgttctcggcaaaataaagggcatcttccggtttcgtatacatggcatcatctttcgcaacgaccacaccttcctccgcgccgccgatggagcctacttcaccttccacagatacatttctttcatgggcataggcaaccacttcttttgtatttttgatattttcttctaaagaaagggaagacccgtcatacatgacagaggaataccccttgtcaatagcttctttcagcgcatcaatatctttgcagtgatccatatgtaaggcaacacttacagaagatgtttctgcgatcgctttcactgcggcgatcagcggttcaaatccgatgtatctggcagtgccgagagaagtctgaaggatcacgggcacgccgagttcctctgccgcttggaccattgccggaagcatctcgaaacagtgcacattaaaagcacccacagcccccttaccttcattttctttaaacaagtctattaaatttctatacatatcggttatctcctttacgcttttccacgaattacatcttttgacagtttcatcagcccgtcaattttatccatgtattctttcatctttgcatcatcttttgcctctgaagcttctcttctctttatgttataaagcttcagcagatcggtatatgctttcccaagggctttgctctctgaaaggctggtttcatatgcgctgatcgccttgtctgtctcctcagcctcaaaatacaggcctccaagctcgttcagtgccttgttccgctcctcccctgaaagctccgggagctctttttgtatggcctcagccttttttaaaagctcttcccggctgatttcaggcacagcctcttctttgaccgctttctcttttttctttttaaacaaaaacattttttatttcctcctgccgcatcataaacaatttatttacggactaaaatattgcagcgattgatttaaacagcatgaacaggaagccggtcactaccgtatccacatccgtacaggtcgtattgatgaatccgatgtcggcaagcatcggtgagagcatcgccggcaggaaggtaataaagattccgtgggcgatacatccgatcatggctccgcgtcttcctcctacctggtttgcaaatatacctgcagttccgcctgcgaagaagttggaaagtacacccggcagtaccataggaagtccgaataccggagtcaggaacattccgatgatagaaccgatggttgtaaagacaaatccgaatatgaccgcattcggtgcatatgggaacaataccggacagtccagtgcaggcactgagtttggaaccagcttcatagaaattccctggaatgcaggaacgatctcggccaaaagcatacggactcctgtcatcagcacatagacacctacgacaaactgcataccctgtaaaaatgcatgaacgataaagtttgtatttcccgcatattctgcacatgcggcaggccctgcaaacgcggctgtaattacataaagcggtaccatgacaaccatgacggaaaggtacgtatcctgtaaaaattccaggctcttaggaagattgatttcctctgtggattttgattttccgccggtcagttttgcgataagagccgtgaacatataaccgatggtacataaatgtccgagcgcgatatcttcgctgccggtgatcttctttacaatgggctgtgcaaaggcaggcatgaaggtcgcaaagaatcctcccacgatacttccgatgataatcagcggtacacctgttaaaccacagtaataagcgaataccacacagagcgtcgcctcccacaacagtgcctggcctgtcaggaatatgtatttaaattttgtaaatcttgcaatgataatattaacgatgaaaattcccgcaagggtgatggcgatctcgcttccaagaccaagctcattcatggcctgtccgttgattccctcgatggaggccaccagacccttcagtccgaacgcggccttaaagatatctccgaaatacgtcagcgatgagacgatgacagcggaacctgcggacagtacaagaaatccgagcatggttttcattgttcctgagatgacggctcccaccggttttttctgcaggaccagaccgagcagcgcaatcaatgcgatgatgatggaggcctgcgttaaaatattattgatgataaaattcaatacttgcatagtttttcctcactttctttttcctcttgtttttaaagttctcccagttcttttaacaccggtacaagcttctcccggatttcgtttttgtctaccagacgctccaaaaatacggtcgggcagctgatcgtataacgctcaaactgcttttcgaaattctttgcggcgatgatgatgtctgcctgtgccccggatacactggaaatatccgtgtgatccatctttgcgtctactcccaggtctttcagtaccgcttccgcactcatctggcatgcaaaactgcttccgagtcctgccccgcacactgctaaaatttttaacatgttctatcctccttttaaattggttgtcgtgtttctttttatagaagccttgtcaggcattactattcttattgagaaaatcaaataattcctgctgatccttcattgcggcgatctccggaatccatcctttttccacgaagccaacgatcattttcagaatgtccagatggctttcgctgtccaccgccgaaaaacagatcaggactctcaccggttccttatccccgtcaaagtagacaggttcttttaaggtgatcaggctgcagccgatgccggtggccccgcattccggccttgtatgcggcatagccaggccgtcggccacgatgatgtacggccccagttctttgatggcacttatgattccttccacataggattgttcggcgcatccctggctgaccagcatttccgctccgatcctcactgcctcctcccagtcttttgcttctgtctgcagctgcacattgttttcgtttaagattagcttttccacttcatatcctccctgctgtttctttaagcttctcttcctgttctaataagtctttgataaactgcccgtaacaagggtgcctcaccagtttcgccacgccggaatttccgatcaaaaactgatataggtttttaaatacaacttcccagacatcgtatttgctctggggaatgtttaacatcaagacgacctggactttttcattttcccagatgaccggttttttcaggaccatgacggaaaccgccgcctcctgcatatcgttaaacagtgcatgggggatagccaccaggcttcccagttccgtggttgacatctcctctcttttaaagatggactgcttgatttcctggttgatatagcccttttcgaccatggcatcggtcataaattcaaggatttcctgtttatccttaaactccatatcggtgaaaaagagatcttcccggaagatgctgctgtaatcaattactttcatttggtttccgctgtctgtaatcaccgtagccaaatgattcaaatcatcgtcatccagaaacagtttgatcttttttattttttcggactgaaaatccggaagctctaccgtagtcagcaccagatcggcgccgtcgatcaattcctcatccacgtcctgcaccggacaggattttacgatctctatgtactgaccgaacttatgctgtaatttttcttttaaaagcagagccgtggcaatgcctgcgatacagaccagaacgactttctttggctcctgttttcggttcagaccttttctctccagtgccgctccgaaatgcatggccagaaatccgatctccgactcttttgccttgagcttatgtttcttttcaatcacctcccctgccacgactgcaagttcaaaggcaagcggatacagatttttgatgctgtccagaaactcatttctgatattcatgtcaaaccggagcctctgcagagccgcgctcaaatgcatggccagcccgttgatcagctgattgtcgtcggacagatcgattcctgtccccgatcggatggtatttaagatatcctcaatttcttccttatactcgtaatccccgtccagattttcgatcagaaatcgctggctggaaatcagatgctgggtcagataatagacttcatctcccagggagatgcccagtttcccggaaatctcagttataatctgctgggcacagcggaactcctttgttcccgagaacagctcaatctcttcttcatcgtattttacatgccgtttcttctcgaaacgcttcagcatgatcaggctgtgtacgagcaggttgcggaacgcgatatccgtaagcctaaggttaaaatctgtgatcgcttccatgagaatgatcctcagattctccacctcatcggacgaaaacatatctttataaaacttgtttcctatatctcctgtgtctttttgactgttgaaaatgtattccgaaatacaaaaccggatcttcgtctcctgccctgcgactctcattccttcctttttcgtatcacggatccgaaggtcatgttttttgagtattccgtcgatggtcctcaggtcttttttcagggtggaagtactcacaaacagttcttcctccagatcaaagaagtcgatcctctccccgctgttcagagaattcagcaaaagtctggaaataatataatgaacccgttcctctgaatccgagggaatgatattctgaaagggctttgaactctcttcttttcggatctcttttttcaggaggtcaaatttccggctgtcactcacagtaagcttgtatccctgcccgatctctgacgtgatctctgctcccctgtccgcaagcatctgattcagctctttgatgtcattcctgactgtccttgtggaaacgcccacagacagtgcaatgcttgccccggtaatccatttttcattttccaaaaagaagcgcagaatcttgatcagcctcttgttgtatctctccatagtttcctcctctttgttattcattataggtatatggcatttttgatgatagttcgtaaatttccgcttgaagcggaaagaaaggcaaaaaaaaagcctgacatccatgtcagacttcttttggttccatcattttgatggtctaactacatactcatccggataaaacagtccgaatttttcacgtgcagtcttttctataaattctttggtcttaatatattccttcttatccttcagctcctgctttttatctttcgccttttctatctgctgttccagctgggcctcctctttttgaagcgccgccgacttttcccacagcctccggtaagcaatggacatcacaatgacaaacacaatgacgacaaataagatcactcttgtgcgcttcctgagtccctttttataactgcttatctttctccccatgtgtctcacctcttttgtgccccttcctcattaaggctattttaacgttttttctctcctgtttcaatctccatctcatatttattcccgcttttgcaaagggatggcggataatacgaaatattttcccaaaaacccttctgatattatgtaataaaaacacaaggccttctaataccttcgggctgatgagcatataatagaccgccatgccgatgatcagtcctaaaaagaaaaatccgcggagctctccccaattataccagcagagaaaccgaaaacacaagaagcccacaaaaatccagtagagcacatcctccactgatacgatccataatttgtgccggaatacgatgcggaaactcctgatgccgtcatagacaaggagcaggcatgccccgaaccagacagcccccaggaagaaataaagctggcctaacactgcttcctgcattattttaacagccttccgagcagcccttcttttttgcctccgttatggtcatccacatctgaatacaggaaactgtcaactttgccgtcaatctccacctcgcctttttccaccaaaagctttttcacatgcaggttaaaccccttgatcatcaggagtccctgttccgtatcgagtatgatctcattcaggtcgaaggacactacatccctcactcccgtaatgacacccagagagcggttcagcagatccactttatgtgttttcataggttgtctatcttctatcatgaaaaaatctcctttcatagtttatacactatatgaaaggagaacgaaaatcatgtgaaaaacatcaaatgtatttgtataattctgccgcctggtctttttttacggtttcttccacccggaggacttccacggccgcctctttattcccgaactggatgcggatctcgtcccccggttttacatctgtcccggctttggcagttttgccgttgacggtcactctcccggcgctgcacgcttcgttggcaacggtccggcgtttgatcagcctggatactttcagaaatttgtctagtctcattccatataactccttaatataaaagaagccgcccatacaatgtagaagggcagcttgatttgtcgttctgtgattatttttcgtttacgatatctttcagagcttttccggctttgaactttggagctttagatgcaggaatgttcatcacttcaccgcttcttgggtttcttccttctcttgcagctctctcagaaacttcaaaagttccgaaaccaactaactgaattttctcacccttctttaattcttctgcaatgacatctgtgaaagcttttaaagctttttctgcatcttttttagataattcagtcttgcttgcgatagccgcaactaattctgttttgttcattgattatattcctcctaatttcgtcataagcattttctgctcttcgattacatgagttcattgtataattaaggtgacagcatgtcaagccaaaatgcgctttattccttattttcagccaattcacgggctttgcgcttcttttctatcttttctaattccttaatcttcctccagctggataattgttcctcccgagtggaaaatgtctcatttccaaacacgtgaggatgccttcgaatcattttcctgcacactccgtccaccacatccgaaaaattgaaatctccccgttcctcggcaatccttgcatgcatcaccacctgaaggagaacgtctccaagctcctcctccagattctgcatgtcatgatgttctatggcttccaccacttccccgctctcctccacaagacagggaatcagggattcatgtgtctgctttttatcccacgggcatccgttttctccccgcagttcttttactacctggataaaatcttcgattgtatagtattctttttcctgcattttaagactccctccgttttctttttatggtatcacattttctgcaaatgaaaagggatttatgctataataatgaaacaaagaaaggaagaactatgattaaattaggagaaaaccaagaactttatattgtaaaatttgccgatttcggcgcatatttaaatgatgaggaaggtgtgacagagcagagcatccttctgcccaaaaaacaggttccggagggagcccaagtcggagaccgcatatccgtcttcgtctacaaggattcaaaagaccgtccgatcgccacgacttcccatcctctcattacgatgggacatctggctgtcctcaaagtcaaagaaatcacagatatcggcgcgtttctggactggggactggaaaaagacctgttcctcccgtttaaagagcagacctccaagatccggccggatcattcttatctggtcaggctctatatcgacaaaagccggcgtctctgtgcttccatgaagatttatcaggcactgagcagtgaacatgactatgagaaggatgactgggtgacaggcaccgtatacagcatcaaccctgagatcggtacgtttgtggccgtagatgaccagtatttcggcctgatcccgctcagcgaatgccacatcagactttctgtgggggactctgtaaatgtccgggtagtccgcgtccgggaagacggcaaactggatctttccccgagagagaaagcatatcttcagatggatgcagacagcgaactggtcatggaaacgatcaaaagctacgacggggtactcccattcaccgacaaggcgagtcctgccatgatcgacaaagagctgggcctcagcaaaaatgcctttaagcgggccgtcggacgattactaaagcagaataaaatcgagatcaccggcggaaccattcgtgcaaaataaacttacaaggagctggatattgtatgaaatattttaagacaccgggctgtttctgcctgatgtatctgtttgtgtacttttttatttcccctctgctgcagtttgcagtacaggaccgatacttgtttatgatcgtgttttatctggtgctgctcggacttggcatcggttatctgaagctttgcagagaagatgtaaaaaagagacttcatctgaagcctctgagaccggcggctgctttgctttccgtccttttggcgtttacaatcctgccttttatcagcctgatcaacaatgtaagccagctgattttccgggatttcattacttccagtgtgtccacggcctcacagaatccctggctgtctatcctggcgctgtctgtacttccggggatcgtggaggaagtgctgttccgaggcgttctttattccggtcttcggaaagctcgtcccatcaaaggaatcctgctgaccgcattgtttttcggcatcgcacacatgaattttaatcagttcagctatgcctttgtcctgggactggtcctgggtctgcttctggaggcctccgacagtatttattcctgtatgctgctccacgccgcatttaacggcgtcagcgtcataaccagcatcatctacggactgaccggcaattcttcgcttatgaaccagaccgtatccacggcccagaggcttcaggccatcgcagtcctgattcctgtaagcattgcttttctggtgctgagtgttctgatcctcatagccatttcccgcctgtgcggccgttccggctatctgaagacgtggcttaacaaggatatccgccgaagctggccaaatgaaaaagccgccggtatctcctactatgcggctttgatcatcagtttcggatatgcggttttactggaacttgtatcctatgcgtcatcttatttgtgatccttttggtggtcattccacgtttccagggtcttgatacagtgataaaacatttgattataaggagttgggatacccagctcctttcccattcttatgaccgctcctgcaaacatctccacctccgtcttccttccggcctcgatgtcctgaagagtcgaaggtttcccgtaaaacggagcgccctcaaaataggtcctgtgttccataagatcttcctctgtcagatgaatacctttctttccggcaatagcgatgacttccctggccgcctgctccctcagctcattggcgtcttcactgatggtccagatgccgtaggggacacggagaatggcagcgctctgattctcgctgacattcgtcataaacttatgccacatattcctcagcatatctttgggcacttcatatgaaatacctcccttttcaaatacctccctcacagaacacacggtctccgaccatgtatcattatacgcatggccgaaagaaattttgccggaaccctccggaaaggaaatttcatttccatggtggagggccggaacccgtatcaccgaatataatacttcattatcagggtaggcggctttgatcctctcctcactttccactccgttcagcagagacatgatgacagtgtgttcccctacctgattcctgatatctttgatggcctggtcaagggccgtatatttcacactcaaaataacaagatccgccggctctctctcccatgagggctcggccgtctggaatttccattgttttccgttaatgataactccgtctctttccagacgctttctgcgctctcctcccgcgatgacgcagaaattttcactgcccagcgctttgcaaatccccggtgccgcgaatcctccgatcgccccaagtcctatcaatgccgcttttttgatttctctcataacaggtttccttccttatctgttaaatagtaattcagatcgcagtggccgctttccgtgtttgccccgggaacagaagcctgatccgtaaactgccacatgtggtattgaaatggaatatccggctcctcttctttcgtgtaatgggccacccacagtttatatgctttaatgccttcataatcaaaatagtgtttcaaaaagtaagcgttggaatagaccatgggcacgtaacccgcccgtttgatctcttcacagaaagctcttgtcagcgccgtcacattcttttttccggttttcatgacttcctcttcctcaatgtcaaataccactggaagcttcagatcttccgggtcaatatcatgctttttcagcagggaaatacagtgttttgcctctttcactgccgctttcgcgtctttggcataagaataataataaactccgcagtgaatggatgagatctttgcgttccggtaattggaaataaacattggatcttctgtgccctttttcttttttcccgcaccggagccgatctttaagacagcgtggttgatctggctgtcctttactttcttccagttgactttatggttatattttgaaacatcgatcaccttgatatggccgttttcgactttcgtctcgatcggcagcccgatattttggatgatccatataaaaataaaagtgacaataaaaagaaacgtgcagatcactgcaagttcccttttatttttccttgtaaatttgaacatataagtcctcgttaatctttgctctcaatcgcatgtacaaacgtacggttatcttcctgttcataactgcatgtgacaaacgtatacagtttctttgttttcatcacagtcttcttcggtatcctggactggatatcactcatggacaaaatctcctccagatatttcttcatgtccttcctgtccccaaatgtgatcggaatcagcttgtcggcctttcttgcgtaagaagcaacgaccttcagatccttcttcccactcggagtatacagggtgatcgtatcctgttttttgataaagctctgctcgcggaactccataaggtctgcaaacatcgatccgtttctcatatggtgcccgtatataatattgtgctccgcgcggaaatccttatccccgtggctgtccataaagactgctccggagctgttttttgtcccctcaaacgtggtgtgcaggtaataatcgttatccttcccaaggacgaccgggtaatcgatattggttcccttggcatagacccagccgatggtatccggattgatcttcctgagtttctcaaaatcaatgattcgttctttcccttttgttttgaccacttcctgtgctatcttatcatattcatcatctgccttcttatattccagataataccccacgagtttccatccgctgaataaaaagacgacgatgcacacagccaaaagaagattagatattacttttttcatgcagcttccctcccctgaaccttattttttatcagtataacacaaaaagaaccggtcttccttaaagaaagccgattcttttcttaatatttatttagccggacgtgcaatcattttgatgcacttggtgtacttatattttgcctccacaacccctactcttcggttggccgcatggatgattctgccgtttcctatgtacaaagccacgtgggaaatattccggtaccgcccgtttcttgtgtaggaataaaagatcacatctcccgggagaagctttttggccttcaccctcttataagaaacgacttttttatggcgcttcatgtacttggcttcactggccgccaccggagcgtaagaacggcttccgaaatgtatgccgtacggcttgtagcagcgccagatcagagaactgcagtcataatatcccttcctcattctccttggctggctgtatcggcatcccttcgctttttttgccttcgcgatggctttgaccgccttataggaagtgacctccgccttataggttttctgttttccgtctatcttgacataaaacttggttatgcctttcttttttggatatataaccagctgatcgtcctgaatataagctttcgccctgctgccgctcacagagacagatgtctggctggtagaactcagccccctgatcggtattttcgcagtccggttctttgccacagttccgctgctttttgacagatatggatttgtaacctgtacgcctgctgtcacgacctggctgcccactacggcctgtacataagtccttcccgccgcttttcctcttacatttccgctgctgtccacagttgcgatgcgttcgtcacctgacttccacacagccctgggagacgaagattctctgactcccacctttgcctgtgcagagactgccacagtcacctgtgaacggtcaagcgtatattccttttcccacacagccgtgagggtcagatctttttcaggcatctcatcggcgctgaaattccagtatcccgtctgtcctccgctctgatcactccagcccttaaatacatatccgtccctgacaggtgtctccggctcagaaataagttctcctgcttccatctgacgcacggcctctctcaccgtgccgcccgctccgtcaaacctgacctgaaatgtctctctctgccctatatcttcctgaatatcttctgttctgccgccctcttttggtgccgctgaaaccggcacagatgctgctgccatagtcaatgccatggcccagactgtgatatattttttatagttcctcaactctcttatcctccggaaactcattctattgtaagatttctgtaatattatcgttaaaccttattcataatatcacaaatattgtcacagaacaagaatatacgacagaaaattccaaaaaatacaatataatcgaatcgaaaaaacttgagatctgcagcaagttggcatggtctggctgatgaggtatactgggaataaaagaaaggagagatcagatgaaacagactttttttgaacatcatttaaatcacaccggacgggaagatatgattaaaatcacttccttcctgaaagaagacctgagaatttctgggatcagagacggcatcgccgtcatccattctccccacacgacggcagggatcacagtcaatgaaaatgcggacccggatgtggtccacgatatgctcttcgggcttgacaaggtatatccactgcatgacaaaaattaccgccacgcagagggtaactccaatgcccacctgaagacatcaaccgtcggcccgtcacagacaatcatcatctctgacggaaaaccggtactcggaatctggcaggacatctacttctgcgaattcgacggacccagaaaccggagattctatataaaaattgttgagtgttaagtatgacattttccacacgatttccgttcggctcttagaatgcctcactccaatcgtgtagaaaatggacatattatctactggagcaggctgcttagaaatcaaaggtgccacctgcgatagtttttctccattgtcggaaggaggcctttccagagccgactggagataatggagaaaaactcagaaaaacggtgccggaatttcttccggcacctgcctgcttgcaatatgtgctctgttaccggcagagcatttttaaaaagagaggattaagtatatatgaaaaactatgtcttcattataacaacttttcctttaaaaacaatatatagaaaataaacaattctaaacatattataaactattggctgtctacccctcttttcttgtagacgatattaaacaccgcaatgcctataacgatccatacaaggcagaccgcatagtgtttcatattggctccggaaagaaaggcagctttattttggtattctccgttcataatctccataaaggcgtttgtgggaagacaaaatgctatcttttccagtaccttgttcattccggcaaacatcggcggcagcatcagcagaagcatcagcggtgtggaaatcgttccggttgacatctgattttcagacaaaattcccacagctgcacctaaaaacaggataccgaccgaagccaaagtggagatgagcatataacccgcaaaaaacttcatatcaagtcccaccagcagataattcgccacggagatcacttccatcaataaaagtacaacaaacatcttgctggccagaaactccatagccctgacatcggacatgatcaaagtccgcagggtatttttctctttttcctccgccaccatcatgctcagcagtgagatcggcgcacagatcagattcagcacctcacagagaagcagggggtataacatccccgtctcttttccgatcggcagtacctttgtgtaaaggacacagaataagatcggaagcagtaaaataaaaaaagtatttttattgcccgcaagcatccggaaatcctttttcatcagtgcttttatgattctcgctcttaatttcatgctaattccctccccgtcaagtccaagaatatcgttttcaagtcgggttccactgaatggatcgtcacaacctctttgtctgcacttaaaagttcctctgctatagccgttttatccttgggaatttcttttacagttccgtccgtgtaaaggatcttcaccctgtcttttgcatatttgatcttcagttcttccggtactccgacctctttgatgaccccttcgtttaagaatgccactctgctgcagagttcgtctgcttcctccatatcatgagtcgtaagaaaaacagtcgttccgtcccggttcagctgtttgatgatatcgtgtacatcctcacttgtagatgggtccagattggccgtaggttcatccaaaaagagcagctttggtttatgtaagatcgccctggcgaacaaaagcctctgtttcattcctcttgagagtttctccgcctttttcttcccgtcctcggttaaatgaagctgatcaagcacctccggaattcttgttttcggaagcctgtaaatctcagaaaatattttaaggttttcctccacagacattttttcataaaagccgctgttgtcggataaaattccgatgttctgatacagcctgctgacatcttcaaacggttccattcccatgacagagatctgaccgcagtcctggcgaagctgtgcactcaataatttgatcgtcgttgtttttccggctccgctgggccctaaaaaaccaaagatttctccctccgatacccggatattcacatcgtccaatgccattttcttctgaaatgaaatgccgacatgttccattgttatgcagtcttgattcatgtaaatacctcctcgtaatacatgcattttattggattctcccggttttcacaaggaaaaacggatgaacggagatataggtccatgaaaagagcccctaaaatccataatattccttcaattcttcaatccttcctttgctgagagggatattttcctcttccccgcctttcatcctgagggaataagaattttttgtccatttcataacttccgaaactctctgcatgttgacgatataagaacggtgactcctgaaaaaaccaaatttcttcagcttgctgcagagttcgtccatagtcatagaacactggaacctgtcctgtctgacgtgcagataattttttccctgcatgctttcaatataatcgatctcgtccggatcaaaaagcaggattttatcacccatcctggccggaatcttttccgccatataaggcccgctctgttcttgtttcgaaaaaatattttccggcagttcttccgcatgctcctcatccacaaaaaaatgccttcccggaagcatatacacatgttttaaagactgagaagtagtaataacctttttcccctgatcaccacacgattcgatccactgtatcatcggctgtacagaatctctgtctgtcccgaggacaggttcctgaaggaataagatatcccggtccataatgatttccctcgccaatgaaactcggtacttttgggaaggtgtcagcgattttatcttacagtaaagaaatccatcaagctgcatggtgcggactgcagaatccagtgtgacatcagaacccgataatcccgcaaataatttgagataggaattcacggtcatatagtcatagtatccttcattctggagaacagccccaacatctttacagagactggtcaatgtttccagcaaaagttcactgatatcactccggcattcaaaatgcagaagagaagttccgtttgatgctgaattatatagtattttttccaaactgagtttcattttcctgtccttatgtcataaagatctgtccggcggtttttcattaccggaacctgatgtataatggcatctctctggtctgtgtctaccggcaggacaatcagttcctctcctgcttccccttctgcaagctttctgccggagggatcgaaggcgagacttctgcccatatagtgttcttcactgtaatggcagcagccaatcgtaaacactgtattctcaatggccctggcacgaagcagagcctcccactgcataaatttatccggaccgtctacccatgctgaaggatagatcagaacctctgcacccttcagtgcctgtatcctggccggttccggaaatctgagatcatagcaggttcccagtcctgcctttccaagcggtgtattcaccggttcatgcagaacttccccgggcagcgtactgtccgattctttccatgaaaatgcatcaaatagatgagtctttctgtaaacagagcagagattacctctgtcgtctaaaaggaccgccgtattgaaacatttccctcctgaatccctgccgggcttctcgctcattccaaataaaatccactgcccatgtgctgcggccagtcttttcattccctgtacaaagggtccgtcgagagtctgggctttttcatagtaagcacttccctctataggataatacgtcataaaatactccgggaatatgacaaagcatgcgctttcttccctggcttcccggcagaagaattctgccttacagagatttttttccggttcctgtgaagctctgcactgagcaatggcagcaatggatttcatatatatgcctcctactcgatatccagattctttttgtataatctgtaattgacccagttgttgaccagatactggaccaccgcaaaaaacggcactcctaaaaacatacccaaaggtccgaaatacgctcctccgactgtaatggaaaagaggatcaggatcggcctgactcccgtagaattaccgaggatcttcggtcccagcaccagtccgtcgaactgctgcagcaccaggatcattccaagaaaaatcagtgttttatatgggcttacaataaaaagaataaatgcgcccggaacggccccgataaaaggtccaaaataaggaatcatattggttaccccgacaataacgctgatcagcacggtatacggcaggtttaaaagactcataagcaaaaagcagaggaacccgataatgagggaatccagtgactttccaatgatatagccggaaaaaatattatggcactctttcagcccatgaatgaccggaaccgctgcatcataaggaaatactgcaaaaataagtcttcggcaggcacttttcaataattgcttatcggccgtcatgtagatggacactacgaaagcaataaacagattaaacagccattttacaaatgaaaccgaaaaattgtacagcatcggaatggcttctgtgagcatttgattggaaagctgcaccagcttcggcagactcttggtctccagtgtttccatcagctcggccgggaatactccggaaccgctttccttgtagtgatccagcagtcccatgatctggtctgaaatgaccggaatctggctggacagttccttaatgctgtcataaagctgaggtacgataaagatcagacagatcgttagtgctccgactaatatgatataagtagtgaggatcgcacatgcacggcataatctttttcgtttttcaccgaataatgatgaaaagactttttcgttaaaaaaggtaacgacagggttcatcacatatgcgatcagaaaaccaataaaaaatgggaaaatcgtattccatagatccgtgagaatcccgaccgtagacgcccagttattgaccaggcggaatattatacacccgataaggattacaacaatcgaataaatcgatatggtaaaatattttttattggattcaaatttattgtttttcaattcttacactccttctattatcctcaggtcacaatcgaattttggctttattctagcacaaagacacagaaaagtatagggtccggcgccttttgaacccggtcttttcaatgacttctgcatcacaaatacatttattattgtcatcgacaaaaagatacaaaaaaattttcaatttttacttgcaattatggaaaacatcatatataataattcttgcgttgaaaatgcagcgcatcatgaaataagcgtgattagctcagttggtagagcacctgactcttaatcagggtgtcgagggttcgagcccctcatcgcgtattaaaacactatttttggcttgtttggggctggggatggtgtttttttatttcgtaaaatgaaaactgtatgaaccggcacaaaagaaaaggagccccctatgaacattgatctcacttccagtcaatatgcccaaaaggcgatgaatttatttaaagaaggatacaactgttctcagtcagtttttctggctttcaaagatctgtacggcatagaccggcacactgccctcaagctcagttcttcttttggcggaggcatgggaagactccgggaagtatgcggctctgtcagcggtatgtttctcactgcgggaattttgtacggatacgactcaccgaaagaccgttcctcaaagacagagcactacaaacggattcaggaactcgcccgctcatttgaagaattaaacggttccatcgtatgccgtgaattgctgggacttgatcaaaaaaaagaatcttatgttccggaagagcgcacaaaagactattaccggaagcgcccatgcgaacagatcgtcggctgtgctgcttacattatggaagaatatatcaggaatcacccgatcctttcataagaatcacaagttttccttaatatttgtttataggatgtttagaattgtttagtttctatacattgtattcgcacataaagctgatatacttaagacatagtttttcatatatattttaatcctctcttttcattgaaagaccccgcaggcatgcggggtcttttatttaacattttctacatgatttccgttcggctcttagaatgcctcactccaatcatgtagaaaatgaacatcatatttgccgtagaaggcctcctttaaacaggcaggtaacttcaggtattattttcctatggctacgtagctataataaaatgttgtcgttccgcttcccatattggagtctcttgcattaaatcctgtctttgtgatatctactgctgccaaacctctgctgtaagaactgtatgcattactgatgataacgattggcggagacgaaaatgttgaagggaaattcacccacttatctgcgttcccatatggtcccactgtaatcggtccgtttcctgtaacaattttcatattctttacgttgttgacctgagaagaaagtgtattcaaatcagtttgatttgccttccctgcgagcccttgtgacacaacagtggaatctgcttttttatttaactcagagcttaattcatatattctgttttttatttcatcaacagaatctaaaagttttttatgctgctcaaccccaaccagtcccgccgagtccaaaacgacctcaaacggtgccgtatctgaattctgaaaacaaaagttccatgtgatggaaaatcccggactttctgccgctgatggaattttctttccctccgaagtctgtgcaatgcagtataaaatttctccctcctccggatcttgtgcataaaatcctacctgatgcagttcatagctttccttcacctctatattttccagcagtacaggaatcacggctttgccgtcctctgtccgtaccggctgcagtgtaatttcctgccgttcgtcggtgatctgtgtctgctgcctcagattcacagaaggcacctctcctgctccggcctttgcccctgtaatttttaacgtctgtccgtcaaacagtttattctgcagcgctgtacccttttccgtaagcgctgtattctcccaaagtttcataatttattacccctctttccacaatatgttctatattagaaaccataccacagctctaccggacattatgggcaaaaaaaatactgccggatgccatccagcagtattttataaatcattttattttttataatccggttttctccgcaataaactttcttgctttcagcgcatactccagtggattcgcctttgccgggtcctgttctgcttccacaagcatgtatccctcatatcctgcgttttccagcaccttaaagatcggatcaaagtcgatgcatccgtctcccggcacagtaaatgctcccatacgcacaccgtctaagaagctcaggttttctgcctttactttttctacgatttccggacgaatatcttttaagtgtacgtgcttgatgcggtccacataagttttcaccatttccagaggatcggcgccgcagtatgtaaaatgtcctgtgtcaaataaaaggctgacatatgcaggatctgtatctgccatcatccgctcaacctcatccgggtcctgcaccacggttcccatatgatggtggaaagtaaggctgatgccgtactcttcttttgcgattttcccaagtttgttcatacccgtgcagaatgtctcccattcctcatcattcatcacatacttatgtccaaagatgggcgtgtccgtcattccctgtacactgtggctctgctcggatgctccgatgacctttgctcccatagcctttaagaaggaaagctgtgcacgaaaatctttctccacttcttcaaatggtttcgtaatcaggaaagacgaaaaccactgattgcagatttcaattccccgcagctctaaagcttttttcagcacttcggggtccttcggatatttgttccccacctctgagccggtaaatcctgccaaagccatctcgctgacacactgttcaaacgtgttttcttttcccaaatccgggaggtcatcgtttgtccatgcgatcggggcaattcctaattttactttttctttgttaaacatagcacttctcctttatccgtgttctttatatgatctgaataaaggataccatggaagaagctcaaaaaaatcgggaatatttttagctttgttgtactaaaaatagatgttcccgatttcgtgtcttatttttagaacttcctgcggtactctgccgggctgaccccatttaaccgtttaaaagcctttgagaaatagtggtaatcgttgaatcccgattccactgcaacatctttaatcttgtagcttgtatttttgagaagatcttttgcatactctacacggagttccagaagaaatcccgaaaagccgatccccatttcctgtttaaacagataactaagataggcaaaattcagtcctacagcatctgcaacctcctgaagcccgatctgctctttgaagtgttcacgaatatactgcactgcctgtctcgtctgtgtccccgcattttcggggactttttttcctgtacccaaaaatattctgcttctgtaatccttaaagatatcagaaagctgatccacatgagtgagtttaaacagttcttcctgactgtgctctgtccccactgccgtatctaatttccgaatccaccggaaaatgatctttgggtccgtccttgtctcccggcatgcttctatcacacgaaaaaactcttctttcatctctttttcttttcttcctgccgcataatccctcacatgatttaaaagttcctgtgcgcactccggcatcttggtcccaatggtcttctggctgtcaaaatataaaatatctctgtcctcataaaaactaagcttaatggtctctcttgcctgctgatatgcctgacgtatgcccccttctccaatgcagatattgctgactgcaatatcgtagtcaaaaatctcctcccggcagcacttgaagcaggcagaggccacactcgtgagtttctgcttcattacactgctcctgctcagatcagaaagatccagaaaacagcagaagatgcctcctcccagagaaactgtctcggccctgctgtgctcctctcccaggagcatttgaagctgagcagacagacgctctatgaaccctgcggcgtattgttccgactcagccggtgactggctgtctttgataaccatccaggcagggataaacatgttgacgaccgcactgttgatatattttcctttaatccccgcctcgatgcgcctttcttcccgctctttagagctcatatctcccgccacaatctcgttaaaaaatcggatcttcaaagactggcttccggcctcgatcagcttttttgtccgttcttcttcactgtttcgtttctttaggctgttcatatggtgttccgcatttttcagcacctcaaaaagggaatcctcgtccagagaatttttcagcacatattcatttgcaccaaggcgcatagcttctttcacataattaaaatcatcatgacagctcagtacgatgatatatgcagaaagtcccatttcccgtaccttgcgtatcagttcgatcccatccatcagcggcatggagatatcggttacgatcacgtcgggagcctgctccctgactgcatgtaaggcctcttccccatcccttacatcggcagtgatctcgtaacccgctttctcccaggcatccagctgcttcagataacttcgcactaaaaaatcgtcatcgacaatcattgttcggtacatggcgttttctcctttcacactgcatactgattctggtctttgtaagccggcagatacagatatgctgttgttccgtcggaagtactgtcatagcccaggccggcattatttccgtaatacagttccagcctctcacggacattgacaactcctatcccgctcaggccgctggttttctttgtcttttttgtcagcagctcataaatctgttcctgtgtcattcctcttccgttatctttgacactgatacataaatagtcttcttcgatcacggccctgatctcgatccggctgctgtccatcttcatatccagcccatgcaaaatagagttttccaccagaggctgaaggatcagccgcgggacaaaacagctgcccgcgtctttccctatctcataatccacatgaaaatgaccgtcatatctcattttctggagatgaatataattttttaaaatatgtatctcgtctgagactgtgacaaacgtaccttttttgttgacacttgcctgcagaagctccacaaaatcaccgatcaggcctcccagttccttctcccctttcagaagtgccgcaaacttaatggaatttaaagtattgtacataaaatgcggggtaatctgatactgaagtgcttccagctctgcatcttttttgagtccttcttctttgatcagcttttcgatcagcttttcaatctggttcagcatgttgttaaagtcattggaaagccgtccaatctcatctctggtgcggacctgaacccttttatccagctctccggcgctgatttcatccatcgccgccgtcaaattcctcaatggctcatacatagccctcgtggcaaaataggcgggaatcagtgacatgcccagaaacagaaataaaaatgccagcaaaaaatatttcagctgattcaggtcgctcaatacgacactcttctccgccgtaataaaaaaactgcagcccgtgaatgccgttttatagctgatgcctatgaccgccgggttacttttattataaatgccgttctgctggatatcggggaaattgctgttcctgtaaattttgcccatggattcggcattcttcgtagagacaatgacatttttcttattgaggaggaccgcgtctgaagatctgccgtcatttaaaatatccagatacttataatagacagccctctcttcaacattacacatgacaaatccaaggacacttccgtcgtcttttatgacgggctcaataaaagacagcactttattctgttttctcaccggatctttgataataaccggatggtcttccagagaaacctctgcaatatgctttaatacagagtcctctactttctttacataaaccggataatcttccgatgtaacaatgactttctgttccggaagaaccagacagactgatccgatatcactgtttcgtttcttgaatcctcccagcataccggacatcttctccagctgtcctgcatcctctgttctcagatagctttctgcctgccgggaaagcccttctgcgttggatgcctgtaccgtaatgtaataaatctctttcatggcatcatcgaaagcattccctacctgctcaatgcggccatagagatttgtcccgtaattgtcctcaatcatctgagtagatttcaaataaaatatcagggtgatggccgaggcagtcaaaaatgtgatgctgatgatggctaagaaaactttactccgcatactgcgtatcatatcagacttcactctcccttccctgatatcttcttctctttctaattatacgtgacacccaaagagtgtcaagctaaccgatttttaatattcgatctttacaatgcctccctttttccaggcttttgtagttgcaaaaccgatctgtgttgattttgtaccgtcatatacggtgacatccggtttcgcacctttctggacacagtgaatgaattctgccatttccagctgataagactctgcaaatctctccggaaagccgctgacacattctttcacagccccatttttatcatagatcatacacagatttttttccggtaccggactgatccttagagaaccctcagtgccgacaatctctgtctcaacgtgatatccatgtgccgcagtacgtccgacatgcacaaatccaagtgcaccgttttcgcatttatacattgccgcaccggtctcgtcatctcctgcttccttaaactccggatgtttgaatgtggctcctgccgcatatacttccacgggatcggattccagaaaccagcgcatcagatcgatgtcatggatggccatatcaatgaagatcccgccgctggtcgctgcaaatttaatcgctccttctgccagggcttccggatcgattcctgccgctttcaccatatatggtgtaccaatggctccttctttgatcttttcctttgcatatgcataagacggatcataacgccgcataaatccaaggaaaaatgtaagttccgggtggcgttccacagcagcctcggctgtcctgcattcctctaccgttattcccagcggcttgtcggaaaacacatgctttcccgcatccaaagcagcttcgatctgccagcagtgctccccgctcgtcgtcactatggcaactgcatcgatatctgctttttccagcatttcacggtaatctgcatagacatctgcaactcccagctgttcttttgcatattccagctccgccggaacaatcgaacaggctgccgtaagttccgcatccgggattttaaatgccaggttatttgcatgcagctttcctaatctccccagccctgcaataccaacttttacttttcccatgatatattccctccttttttgatatttcgccttccaatagcttcctactttgatctcttataatctgtgcctttggttctattttaccttccggtatccgaagtcgtatccatggatttttttagatttgatattatatttttgtaacgcattccggctgttatttaatagatgaaagtaaaggacctttggtctgccaaaggtcctcagatatatgtactatttttatttttgtggttttatttttagatctgcctgaatgattttttgttcaggctgcttttttccttctttttggtttacgatatagcgtaccgtctcatagccgatttcataacccggctgataagccaaagccccgattttccccttcttgaccgcatccagcgcatcctcctgggcatccactgtggcaatcagcaccggccggtctccaaggtactccatgattccgagtgcggtcacggcgctcgtagcaaaaattccgtttaaatccggatgttctctcataagccttgaaatctctttctccggcatccgcagattgctgtatccgctttcggtaaaggcaatctttatgtctgtatttttatctatatagtcccgaaagcctttcagccttgaggcatgggagctctgtttcagattccctgatataatgcccacaagccctttctttttcatctgtgccgccatatattgggccagttctctgcctactttttcattgtcgattccaatataaggaactcccttctcgagaatctttgtgtcataggatacaacctgaatccctttttcttccgccttttttaagtagccctttgcattatgtgagttgattggggataccgccagggcatcaatatcttttttcagaaggctgccgatcatctgctgctgagtcttctcatccgtctccgtatccggagacataataatgacctttacccccaggtctgaagccgctttttccatgccggaacagactgacatccagtattcactgctccgtgattttgtcacgacaccgatcacatacttaggattctctgcctcgtcagactcatgcacttggcaggcagacaggcttccaccgagcaaagcacacaaaagaaccgcacacagaaactttaccctgctatgttttttactcttcttcattcatatccacctctcaggaattctgggattcaattttctctgccaaatcgttcaggtaaacccaccgctccatcttttcgttgagctgctcctcgagtttcgacttttcttccgtcagttctgcgagccttgtatactggctggcgttttcctccatctgctgtccgacagatatgattttttcttccagccgttcaatgtcctcatctatagtttcatattctctctgttctttatatgaaaacttcagcctggtatctttctgtttccatgatttcttatccgttttttcctttggctttggctcctccgccggttttcctgctctcagatagtctgtatacccgccctcatactgctttatctcaccgccgccctcaaatgcaaaaatccggccggcgatgcggtccagaaaatagcggtcatgggagacagccaaaacgatcccctgaaaagaatccaggtaatcctcaaggattctcagagttgctatgtccagatcgttggttggctcatcaagtacaagcacgttcggcgcatccatcagaactttgagcagatagagcctcctcttttctcctcccgaaagtttggacagaggtgtgtactgcatggaaggcgtgaataaaaaacgttcaagcatctgagacgcactgatcttcccgccgggtgtctgaatataatcagccacatcccggatatagtcgatgactcggatgccgtcctccatgtcttcattttcctgtgcaaaatatccgatctttactgtatccccggtcacaacctctccggtgtccggggccagacgtcccgttatgatcttcatcagagtggatttgccgcagccattcggcccaatgattcccagccggtcatcccttaacaagatataggtaaagtcttttatgagctctttctccccgtatgccttggaaatccgatggagttcaatcgtcttctttccgagtctcgtgcccacagaatccatctcaacgttctggacttccctggggccttccatgtttttcagctgttcataccggtcaagccttgctttctgtttagtccccctgccctgaggccctctcttcacccattccaattcggtccgcagaagactctggcgtttgcgctccgtggccagttccatctcttctctctgtgtctttaaagccaaaaatcctgagtagttggagtcataggtgtacagctttccctcgtctatctctgcgattttattggttacgcggtccagaaaatagcggtcatgggtcaccatgatcaggactcccttaaaccggttcagataatcttccagccagagggccatgtcattgtctatatggttggttggctcgtccaggatcagtacatccgccgggtccacaagggtccgggccagcgcggctcttttcttctgcccgccggacagatgatccacagattcatcgaaatcacagattccaagttttgtaagaatcgtcttggcctcactcaccggctcattcccatccggatcatgtttcccttccgtcacataagacagcacctttgccccgtccggaaactccgggttctgtgggagaaaagccgtgcggatacctctgccgaagatcacctctccctcgtcagccgtttcctgtcctgcaatgatctttaacagagttgattttcctgtcccgttgacgcccagcactccgatcttatctccctgatgtactcctaaagagacgtcatcgaatatggtcttatctccaaaagttttactgatatgttctatgtttaatatattcatggatccaccttttcttccttgactatctgttttttagtttaattgctgtcttacatcttgtcaaacgaaatcccggtgcagacccacagaaaaacggatggccggtttacgttccgtccatccgtctttatacagtcatttcctgacccctaacgcgctttatccacggctgcttttaactcttccttaggcacagctcctacaacttttgctgccacctggccgttcttaaagaccaggaacgtaggtaccgacatcacgccgtactgccctgcgatatcactgttctcatcgatatccagctttccgactttaacgcttccctcgtactcttttgccagttcttccacaacaggccccatcattctgcacggtccgcaccatgttgcaaacatatcgacaagtaccggctgctctgagtctaacacttctgcctggaaattttcattcgtaaacgtatactccataatcattctccttatcttgaccggcataaacaatcttttgcctcttccagcgatgccagcaggcggcagaaccatttcctgtgctttggatgctggtagaaaaattgatttacctttacttgacactttttctgtttcataattatcttaccacttttttattatagtatgcaatacggataaaaatattaacggcaggctgtaaggcggcagattggactgcctttttcagaaaatttcttctcatattctgtcataacattgtcttttgcaaactcactgtgatgcagatcaaatgtacagtcaagaagtttccatccggcttcctccgtctgttccagggaaaagtcaaacagcccgcggttgtctgttttgaaaataacctgtccgtccttcgcaaggatgtggtcatacctctcataaaatctcgtagaagtaagcctccgctttgcgtggcgttctttcggccacggatcggagaaattcagatagatccggtcaatctctccctcggcaaaaacatcctggagattctccgcgtccatgcggatcagtcttaagttattcccctcgaactcttccgttttttctaccgctctcacgagaacactggaaaacttttcgatcccaatatagttgatgtcaggattcttttctgccaatgtcaaaagaaattttcctttccccataccgatctctatatgaaccggcctgtcattgccaaacaattccctccacttgcctttccattcttccggttgattgacggaaaatggactggccgctatcatatccgccgctcccggcacattccttaaacgcattgtatcttcctcgccttctctgtattcatgtttctaaaacattttaaaagctttctgctcagttgtcaatttcctttgcattctgtctccgctgcgtatataatgaggaaaaaggaggaacgcactatggaaatagaacgcaagtttattgttaccgacccgccgaaagaccttgattcctatccccactccgagatcgagcagggatatctgtgcatggaaccggtgatccggatccgcagactcgaccatgattacatcctgacctataagtccaaagggctgatgaaacgggccgagcatgaatttcctctgacaaagcaggcctatgagcacctgaagagcaagatcgacggtatcctcatctataagacgcgctaccagatccctgcctcaggctctcttaccattgaactggatatcttccacggagaccacgaaggactaatgatggccgaagttgaatttccgtctgaagaagccgctctggattacgaagggcctgagtggtttgaagatgaagtaacattggatccacggtatcagaataacaatttggctaaccgatgaactcttttgatatgatgtcccttcctgcactcaccgcaggaagggtttttattatgtaatattgcagtgtcagacttcagacatcgtataaatcgtatatccatcttttccacgctgttttgtggcatatagcgcactgtctgcctttttataaagtacttcaaatgtcatgtttctgccctcggagacagcaatccctacactgaaagaaacattcatgcccgcggaacggagcatttcttttattttctctgccttttcctctatctcttttctgtctgaaatctcatcgaaaaaaacaataaactcatcgccgccgaatctccctgtaatatcagccggactaaacaattttttcagctgcagggcagtctgggcaatgacagcatctccctccatatgtccgtagctgtcgtttattgctttaaaatcatcgatatctatcataaagagcgcatatttctggccttcactctgttttcccaggcgctgcctgatcatatgctctgatgttttcttattatagagccccgtagatccatccagcatagccgacgtcttcagcttgatctgctgctgtttcagctctgtgatgtctctttccatacaaaacagccttgccgaagccttgtccccggtaaacaccgggaccagagttgcagaataccagcgttcctcttcctttacggcggcctcatactcaaaacagacagaagggatgcttttcttgatcgcgtcccatatatactccaggctgaaagtttttgtaaaggcttcctgaaactgaggcgcacacttctttgccgaacatgatacaatttcgctgtacggcagatctctctgctcccagacaccctccacccggcaggaatgaatctttaaccgatccgcagacagatccacttcaaaaaacaggtcactggacttgctgagcgccgtgtgataggcatttttcatgagaaccagccgctttttttctttctttcgctccgtcaccacaactgccagcaaaacggacatggtgcctaccagttcagcagtgagcagtctccccattttttcaacgagctccagatgtgactgtgccgaatcctcccggccgcctcttaaatcagaccggatctgccagttaaaattaaaaagactgcagagaatcacaacggctgccacaaccgaagcggtcactgcaggcccaagcttttgatataacctcctcatgtctttacagcccctttccataaaacaggaagaacatatttctgaacacggctctcacagctgcccgtccagaaatatgttctgtctacatcctttttgataattcttctctgaccagagctctcctcaaagacatttcagctctgtgaaggtctgtatcgctcttgtgtttcaggcgttcctgggcacgccttttggcacgctccacccgctctaagtcgatctcacccggccattccgcaacctctgctaagatattgacagcctccttcgtgatctccacaaaccccttcatcaaagcagcctgtttcttcgttccgtctgactccgtgatggtcaggataccaggagctatgatcattgtcatcggaatatgttttgggtagattcccacattcccttctgtggtcgtaaactcagccatccggacctctcccgcataaaaagagcggtccggagtcgttacttccagtttcatcagattttcagccataggatcacctgcctactttgctttcgcacgttccacaacctcatcaatacttcccgcattcaggaacataccctccggaatgtcgtcatgctttccgtctaatatttctttgaagccctggatcgtatcatttaaggttacatattttccaactgtacccgtaaactgttctgccacgaagaacggctgggacaggaaccgctgaatctttctggcccggtctacgatcagcttttcttcatcagaaagctcatccataccgaggattgcaataatatcctggagttctttatatctctgaagaatctcctgcacccctctggccacctggtagtgttcttccccgacgatcttcgggtccaggattctcgatgtggactccaggggatccactgccggataaattccctgttccacgatggcacgggagagtacggttgtggcatccagatgggcaaaggttgtcgccggtgccgggtccgtcaagtcatcggccggcacatagactgcctgcacggatgtgatggaaccgtctttggtcgaagtaatccgctcctggagagcacccatctcggtctggagagtcggctggtatccaaccgcactcggcatacgtccaaggagtgctgacacctcggagcccgcctgggtgaaacggaagatgttgtcgataaacaacaggacatcttttccgccctcatcacggaagttttctgcgatggtcagtccggtaaggccgacccgcatacgtgctcccggcggttcattcatctgaccgaataccatagcagtcttgtcgataactcctgactcactcatttcatggtaaaggtcatttccctctctggttcgttctcctactccggtgaaaacggaatatccgccgtgctctgtggcaatgtttcggatcagttcctgaatcaggaccgtctttcctacgccggcaccgccgaacagtccaatctttccgcctttctggtacgggcataaaaggtctacgaccttgatgcctgtctccagcacctcagtctctgtggactggtccttgaaagccggagcctttctgtggatcggctggcgttttgcattctcaggggccggtttattgtcgataggatctccaagaacgttaaacattcttcccagggtctgctctcctaccgggacggagatcggcccgcctgtgcagacagcctccatccccctgaccagaccgtccgtcggtcccatcgcaatacatctcacggtgtcatcgcccagatgctgggaaacctctacaaccagcttcccgccctgctttgtcataatatcaatggcgtcattgatctccggcagatgcccgtcactgaacttgatatctaaaaccgcaccaataatctgggtgatcttccctgtatgattatctgccatttaataattcctcctacttctattccagcgcctccgctcctgaaatgatttctgtcaattcctgcgtgatagcgccctgtcttgcccggttataggcaaggcttaagttgtcaattaattcttcggcattggtcgttgccgaatccatggcctgcatcctggcaccgttttcgctggcaaccgatgtgacaagcgcaccgaagatcagactgcagacgtacttgggaatcagcatggataaagcttcttccggttccggctcatagttcatgagtgtcttggagtcttccccgtctttttcctttgaatcgatctccacaggaagcagtttgatcatggtcggctcatgaactaccgtatttttaaaattggtatatgccagatagatctcaccgatctccccgtcctcgaaggcctttaagacacggtttcccagattgacggcatcttcgtactccggttcgtcgatcatctcagagtcatcggcgacaatatgataacccctgtttgccagactgtccatagccttatgtccgactccgtagatcattacatcttcccttgcgagtccgctgtcacggatcatttttacaatattgttattgtaaccgccggccagtccccggttggaggatacagcgatcactgctttcttctgcgaaccgttagactttaaatacggatggtcgatattatctgactgggctaagattgaagatacggtccggtacatcttgtcaaaataagtcctggattcctcggccctcgctcttgctctctgaagctttaccgttgagacaagcttcatcgcctttgtaatctgtccggtgctctcgatactggcttttcttctttttatatcaactattgatgccataaaagctcacctctttactttgcctcaaactgctgcctgcactctttgatcgcagtgatcagcatttcttccgtctcttttccaagctccttcgtctcccggattgaccggaacacatccggatattttgtgtcgatcagctcaaacagctccttctggaaggctaagatgtcatccaccttgatctccaggagatattttctggtagccgcgtaaatgatcaccacctgctgttctaccggaagcggctgatactgaggctgtttgagaacttccttaatcctctcaccctgtgccagacgctctttcgtatcatcgtccagttctgaaccaaactgggcaaaagcggcgagctccctgtactgggcaaggtcggtacggatcggcccggcgatctttttcatcgctttgatctgtgccgcaccgcctactctggatacggagagacccgcattgatcgcaggacggaatcccgcattgaacatctcggtctccagataaatctgtccgtccgtgatggaaataacattggtcggaatataggcagatacatcgcctgcctgggtctcgatgagcggaagggctgtcagagaacctcctcccagttcatcggacagcttggctgccctttccagaagtcttgagtgaagatagaagacgtctcccggataagcctcacgtcccggaggtctccgaagcagaagggacagggtacggtatgcggttgcatgtttgctcaagtcgtcataaatgacaagaacatcctccccgttttccatccactcttccccgatggcacatcccgcgtatggggcaatatactggagcggtgccagctcactggctgtggatgccaccactgtggtgtaatccatggctccgtactcttcaaatgtctttacgatgttcgcaaccgtagacgatttctgaccaattgccacataaatacaatggacgccctggcctttctggttgatgatcgtatccactgcaatcgcagttttacccgtctggcggtcaccgatgatcagttcccgctgcccgcgcccgatcggcaccatggcatcgatcgctttaattcctgtctgaagcggagtatctacggattttcttgagataactcctgatgctactctttctattggacggtacttttctgtctcgatcggaccttttccgtcgatcggctgtcccagagaattcacaacacgtccggtcatcgcgtcacctaccggcacttccacgactcttccggtggtctttacgacatctccttcactgatgtttttctggtctcccagcagtacggctccgacgttgtcttcctcaaggttcagcaccattccgtatacttcccccgggaattctaaaagttctccctgcatggcctcatcaaggccatggattcttgcaattccgtcggctacctgaatcacggttccaatatcagaggtttcaagcttggtagagtattgtttgatctgctctttaatgacagaactgatctcttctggccttaaattcattttgcttttttgcctccttgcctataatcacaactgtatttttgacagacttttccccatggtctgaagcttcgtccttatggaactgtcgatgaccctgtcgtcgagccggagcaccagccctccgatcagctgctcatcgatctcatagtccacttcaaactccctgtaatctgtcagttctttcatacgatccacaatgtcctttttctgcccttctgacagttcaaaagcggaggcaacccaaaggctccctatcccctctttcttcttcatccggccgatgatatagtcgagaacagacattatgtcacggtatcggtcttttttcacaatgaccaacaaaaagcccatcatgtcctcagaaatcctgcctttaaatgctgtttccaggatccgcattttttcttcttttacgatcttggggtgagaaagcatctgattgagctccccgctctccgaaaacacccggcgcacactgaggacttcttctttgacagagtcaagatttcctttttcctctgccagcgaaagataggcatctccatatgttttgctgactagcttcgccatgtctgatcacccatctcctttaaggtctcttccacaagggcatcctgctttgccggatcgatcttatccgttatgatcttgcctgccatagccactgccacctggatcatttcctgtttcacctgatcccggacctttttcttttccagcgcaatctcattttccgcccgctctgtgatcttcagcgcttcctgtctggcctccgaaatgatctcgtcttcccttttcagggctttctttctggcctggcttaaaatctcatcggcttctttttctatatccctgatcttttcttcatactcagctttcagtctggccgcctcttctttgtcggccgccgcagtatccagatcatctgcgattttattcttgcggtcatttaaaagtttcctgaccggttcaaataatacataagataaaaatgcaaacatgatgaagaccgcgactgcctggcataaaacgtcaaatccaagctggatatcaagtccaaagattctgtccacgtcctgtcctcctttccctgaattctctccggtttgtcatattccgacggcttctgccgccgttttatctcccggattataatttagcgaataacgggttagcgtataacagaatcaggccgataaccaatccgtaaagacctgtggtctctgcaactgcctgtccgagaagcatcgtagacatgatatctcccttggcgcccggattgcgtcctacggctgccgcaccctgtcctgctgcgtatccctgtcctacaccaggtccgatacctgcgatcagcgcaagtcccgctccgattgctgaacaacctaatacaaatgcttcacttgaaatattcataagaaaatcctcctaaaaaataaaattgttctttttattgctcctgatagtttcttccggtttatacattcctcttgtctgcgataaatgtcatggtcagcatggcaaatacaaaggtctggatcgcaccggaaaacaagtcaaaatatacatgcagaaatgccggaagccccagcttcgcaaagatcggaagcaggccgtaccacagcgaaagcataatggtccccgccatgatgtttccgaacagacgcagcgacagcgacaccggagttgcaaattcaccgatgacattgaccggaaacagcactggaatcggctgaaacagatccgtaaacatacgaaacttccgtgtcttaaatgcgctgtactggatcatcacaaatgtgatcagcgcaaggcttaaggtagtcccataatcggccgtcggagcccgaagcccaaacagtcccgatgtattggcgataaagataaaaaacatgatgcttccgatatagttggcaaacggcttccaatgttttcccatggtgctcttgaccagcttatccagcatttctaccaccagctccacggcattggccagcccgctcggcttttcgtaatctttcatgatgctccgccttgcgatcaaagccagcaccattataaagagcatgacaatcagtgttgtcacatgagtggtggtgatccataccttatgcccgaaaaaattcaatggtatcagcccatgcaccatgaagtccacatcacttcccgatgcggcagccaacatgggggcctgaatcattcccatagcattccctcctttttaattcattttactttctacttcttcgttcctgccggatcgtctttccgatacacggcggtggatcagcggctgcagatatgcggctattttaatccccaaaactccaagtatgatccctgaaaatgtcagcatatggatcttaatcccaacagctgccgcaaggacagtcagaaccttgcggaccagagtccgccttaccatatacttatttgcagactcgggatccagatccagcgcagtatcaatggtcagatacatattcaggatcagacagactgcaaaaaacaggcccgcaagaatccctgccagaaagtacagagatccccctgatgtgaccatgccggctgcaccggccgccgcaccgtagatccccaatccggccagcaattccaaaagaacgggattgatttctttaaattcttctgtcatcatcaccctcctggtcttcactgacattccttatgagtttccaggcaccgctcagtcctccgccaatgcccagaatcaataacgggataaaaaaatgggtagaaaactttcggtccagccagaggcctaaaaacatgcacagaaatgtcgatgtcagaatcgtaattcccagctgtgttatcagagataacgaacggacaatgtccttattgatcttcataaagacctccttgaaaaaagtttctactcacactttgtaattatatcatccaaagcatattatggctaggaaaaaaagctctgtaaccgagggcattccttttacagtagctattatttccatatttatctggtatttattctttttcttgttttccggacaagtattccttgaacacaagaagctatccaacgatatttttagcactattggaagtgcgcatttcaaagcgtgacggaaatagtggtttaaaaaactctaaaaaaactgtcgcactaaaaaggtgcggcagctttttgcacgaaatacacgaaatatcttctggagaaggctaatgaataaagaaatcttacatctctgagacagcaagccggaaaactggtcaaaatgttatacggcacagaagccgcgagtgctgtccatgccgtataatatcttcttaaaatttagtcctcgatcatattgatcctgcggatatgcctctcatcgttagaaaattttgtctctaaaaatgtgtccacgatatcaagtgccaggccttctccggtgactcttgcccccagtgccagtatgttggcattattatgttctcttgttgctcttgcgctgaatgtgtctccgcacagtgccgcccggatacctttgatcttattggcagtaatggaaataccgattcctgttccgcagatcagaattccctgcttcacttcgtccttcagtatgccctcagccaccgcttttgcatataccgggtaatcacaagactcctctgagtagcatccgtagtcttttaccgcgtgccctttctcctccaggtgcttaataaccgcctgtttcagcgcatacccgccgtgatcgcttccaatacctatcatttcatttcctcctaacttatggttccagattttatggattagttgtgtaatctgtacaaagcaatgttcatagtcttcatcatccatcccgtaagggtcgatgaccgccccctcatcattggcatactcgttgatggtggccacttccttatatccatgatagtcttccagtactttttctttctgcttatcattcatggtgagaatcagatcactggtctccacatcttcctgtgtgagctgggacgctttgaaatctatgatctcaatcccgctcttcctgaccaggtctgctgcttttgtgtgtaccggctccggaaataatacgacgagtcctttggactccacctggatgtctcttctgtgagcgtcttttaaatatttccgcagcaccgattccgcaataaaactgcggcaggtgttgttcgtacttacaaatataatttttttcaaactaatctccttttaaacacggatcatctgatgtcccgctgctttcaccagacggttcatcaccgcttcttcatactcttcaccttcaaatccctctgaaaagatcacatccacgtctctgtggtcaaattctctcagcacgtcatagaggtttgccgtcactgtctccatatggctgcggctccccacagagattacctcatctgcatcataaccgcccattgtctcttccgtggcaataactccggtcttcatgccctgttcacggcagtcacggacccttttcgtgatctcctctgctactttctctctgtcctctccaaggataaggaccagctgagctttcggcgcatagtgcttgtacttcattccaggtgccctgggcactgtatcctctttcactgacagagtactcatcagcacctctgtcgaaagagccttctcaagttcatcttttgtaatctttcccggccttaaaatgaccggtacttctccggtaaaatcaacgatcgtcgattcgacgcccacttctacttttcccccgtccaataccatcgggatcttgccgtccaggtcttctaccacatgttccgcctttgtggggctgggccttcccgaagtgttggcgctgggcgcggccacaggaacacccgcctctctcagcagggccagcgctgcaggatgactgggcatccggacggctacggaatcgagtcccccggtaacccggtatggaaccttgtcgcttttgggcaggatcacggtcagcggacccggccagaaagcatccatcgcttttttggcaggccccggtacgcaagatgcgatctcatcgatcatctccatgctcccgatatgaaggatgagaggattgtcagagggtctcccttttgcctcgtagattctggatgcggcctcttccatccagccgctgcctccaagtccatagactgtctccgtgggaaaagctaccagtttcccctcccgaagaagcccggcagcttcccggatcgcttccttattgtccttgttttcaacgtttctcactattgtcttcataaaacccatccttcttctgagaaaaacccattaacaatcattataacaaacttttcctaaaaaataaagcagggagttttccgccataaatcataaacctgctgcctggctgaatataatactttaattgccgcaaagaggtttgatatatggttcaaatattttctctgatcagccgtctgaatgatgcattcaattcctttatctggggaactcctatgctggcctgtttcttaggtgtcggcctgatgtttacacttaggacaaaatgcttccagttaagacatttcagattgtggatctcttccacgctcttgtcctctttgaaaaaatctgaggtaagaaaaacaaaggattcggcttccatctcacagtttcagtccctctgcaccgccctggccgggaccctgggaaccggaaatatcgccggagtcgccactgccatcactgccggaggacccggggctattttctggatgtggatttcttcgatcctgggaatgatgacacattatgcggaagtcacactcggaatgaaataccgttatcgggacaaaaacggaaaatgggccggaggtgccatggtctatatggaacggggcctcggcgcaaaatggctggcctctctttttgccgcattctgtattctcgcttctctcgggatcggaaacatggcacaggcaaactctatggcctccgcgctctcctccaccttttcaatttccccggtgatcacaggtctcgtcaccctgttcatggtaggtttcgtcataatgggaggcatcaaacggatcgccggcgtgacagaaaagatcatcccggtcatggctgccttattcacactgggctgtattgtgattatttttgtccacatggaccggattccatccacaatccattcgatcctccacggtgccttctcaccaaaagctgccggaggaggtgtccttggctacgggatcaccattgctatgaaaaaaggaatctcccgcggggtcttttccaatgaggcaggattgggaagttccgtcaccgtacatacaaactccgacacaaaagaacccgttgtccagggcatgtggggtatctttgaagtatttaccgacacggttgtgatgtgtaccatcacagcccttacgatcctcacttccggtgtctatgacgagggaacctatctcaaggctatggctctggatgcggcccagggcaccacgattcattttgattcactgcccaacggagtccccctgaccagcgctgccttctccacagtcttcggctcctggggctccgccttcgtatccatcgccatcgtattctttgcatttgccaccctcatcggctggtccttttacggtgagacggcagccgtctatttatttggcagaaaagccgtcaccaattataaacttgtttttctctattttatatttttaggctccattctgcacttatcctttgtctggaacctttcggatacctttaacgggttgatggccataccgaatctgatctccatcacactgctgtctggccaggtcgtaaaaatgaccggcgaatacctgggacggcacgacatcaaaagaaaatttccaaaatgaccaaatcacagatcagaacttttaacaaatcatacattatgtccattttctgcatgattggagcgaggcattctaagagccgagcggaaatcatgcggaaaatgtcattcatatatcaggccttgttctgaatataatattacaaaagtcctgaggtctccaaatgaaatatcgtaaacaacttttagggggcgcgatcttctgtatcatcgtcctgctctatatttcctcgatcacccttccgatctttgtaaaccagacgatcgggaaacagaatgtcatcatcatcgatcccggacacggcggcaatgatcccggaaaagtcggcagcggagatgtgctggaaaaagacatcaatctggccatatcaaaaaaattaaaaacgatcctggagaagaaaaaattcaaggtaaaaatgaccagggacggcgactacaatctggccaccagcacgaccaacgtgaaagtttccgatctttccaacaggaagcagattatctttgatgccgagccggttcttgtggtgagtgttcatcagaacagctatcccagcggtgaagtacacggtgcacaggtattttactatcaggggtctcaaaaagggaaacagcttgctgactgcctgcaaagttctctggttgaaaatttagatccagacaaccacagagtggcaaaagcaaacagcgattactttcttcttcgggataatccttatgtaactgtcatcgcagagtgcggttttctgagcaatgaagaagaaaagcagaaacttcaggataaagcttatcaggagaaagcagcacaggccatctataagggaattcaatcctatttaagccaagagaaataatcccttggcttaattgagatactactggtatagatgacgcattgtttaatgattggttactttttgataatagacggcacagatctcccctttctcatcatcaatgaagtctttcatgtaggaatcatcttcctcaagcataagatccatttgttcctgattgctgttgtctacgggtattccatcgacctggactgccaatccaagttctaaataatccaataaatcactgcgatgtcccatgataatctccattctgaaatgtttgtgaaatgagccagaaaagtgctatgatatataaatttaagacactgccgaaaaggcagcgaagatgcggcgcctcagcgaaggaaagagctcttttccatatgctgtaagtttataatagcaaattctgtaaattatttcaagtatttctgtatatttttgtaagttattcagaaacactttacacatatgcattcagatactatactataatataaagtaagggagtgatgactatgaagatagaacgaattagtgacaatcaaatccgatgtactttgaataaagctgaccttgctggaaaagagacactgctcaacgaactggcatttggttccgataaggccaaaggactgttccgcgaactgatgaagaaagcttctcaggaattaggttttgagaccaataacattcctcttatggtagaagcgatcccggtctcccaggaatgtctgatactcgtcgtcacgaaagtggaagacgccgatcagtttaatgaccgttacgagaaattagtcaactcaaagatttcatccggcaatatgaacctggaagattccgacggagttctcaatttcctcgacgatgcttctgacagcgatctgtccgaactggctgatgcaatgcatctggccattatggattccaactgtgacgtatactgcttttcttccctggaagaagtagcttatgcagcaaaactggtgataagctttccgcatgaaagccgcttatataaagataccgaaaataactgttattatctctgcctgtctgccgaggacaacaagtatgactttacaaaagtccgcagcagactttcagagtacagcaaacgtatcccaaatacttatgcgactaaggctttatttgatgaacattttcaaaccatcctttctgaggatgcgatccggcagatagccgaattttaacttaacataataaaaaggaaagaacctgtgtttattgatgcgggttctttttttgttccaaaaaaaagacacaaaaaataattcacccataattttatataaaaatactacataatccaaaaaaagtactagttttggtaatatctttgtcctgatatgattaactcataaagaaatcagaccagttgaatataagaaaggacgtttttattatggtaaatgtaggtattattggagcaggaagaatcggaagagtacatgtagaaagcatctgtacacaagttagcaacgcaaaggtgaaaacacttgcagatccttttatggcagaggatacagcggcatgggcaaaagaaatgggtgttgaaaaaacaaccagagattacaaagatatcttaaatgatcctcagattgatgctgttttaatatgttcttccacagatacacattctccaatatcagtggaagccatcgaggcaggaaaacatgtcttctgtgaaaagccgatcgatcatgacgtaaagaaaatccaggaagtcgtagacgctctgaaaaaaagcaatgtaaagtatcaggtaggatttaaccgccggttcgaccacaactttgaagcagtaagagatgccgtggctgccggaaagatcggtgagacacagatcatcaaagtgacatccagagaccctgaaccgccaagtgctgattatgtaaaagtctccggcggaatgttccttgacatgacgatccatgactttgatatggtacgcttcctggcaggatgtgatgccgaagaggtatatgtggaagcagccgtcttagtagatccggccatcggtgaggcaggggatgtggacactgcagtcattactttaaaaatgaaaaatggcgcgctcgcagtcatcgacaactcaagaaaagctgtttacggatacgatcagagagccgaagtattcggatcaaaaggaatggttgctaccgcaaatgattccgtatcctcagccgtgatcagcaatgcagacggtgtaaccggagaaaaacctctttacttcttcctggagcgctatatggccgcttacgcaaaagaaattaaatgctttatcgacgccattgaaaaagacacagacacacctctgggagttatggacggacttgagccggtactcatggggcttgcagctaagaaatcactggaagaacaccgccctgtaaaaatttctgaaatcacggtataaagaaacaccagcctgccggttttcccggcgggcaggctgtcatgccatatgaaattaaggagaagaaaaatggataaaaactatgtcaaaggccacaaactcacctggggaacccgggtctcctacgcaggcggggacgtggcatgtaatgtaatcttcggaatgatcggtacattgcttacgcttttttatactgattatgttggaatcaatccggcaactgtcggattggtcatgctgctttcccggctgtttgacggagtgtctgacttaatcatgggtgtcatcgttgagcacaccaactcaaaatggggaaaatcaaggccgtggatcttatggatgagcatcccttatgctctttcagccgtactgcttttcactgtgcctcatacaaccggaatcgttcagggaatctacctgtttgttacatataatttttgtaccacagtctgttatacagctattaatcttccatatggaagcctttctgccatgatgacacgcgtctcttctgagagagatatgctgagtgtcgttagaatgggattgtcaccgatcggacgtatcgtagccgttacctttactcttccgttagtaaagatcttcggggataatcaggctgcatgggttaagacaatgtctatctgggcggttcttgcattgatcctgctcatcaactgtttcctcaaatgcaaagagaccgttgtcattgcggccaaagataaagtaaaaagtatccctctgaaaaagggcctgaaagcccttgtcacaaatcaatacttctgggcagttctcgtattatggatgcttcagagtgtatcctttggtatctcagggaccatccttccatactattgtaaatacattttccacaacgatacctggatgtacagtacattgtatctgacggaaactcttactttggtagcctgcatctttgcctgtgcgcctctgatcggaaaattcggaaaaagaaacgttgcatttgccggagcatttatcgcactggccgggcagcttctgttcttcctgaatccttacagctttccgtggatggtcatgagctgtgtgactcgtgctgtcggactcgctccattaaatgcagttgtcttcggaatgatcggcgatgtggtggaatttggtcagtggaagacacatatccgtcaggaaagcctgatctttgcaggaggctccatcggcacaaaagtcggcgcaggtgtggcatctgccgccatgacaggactcctctctctgtcaggatatatcagttctgccgccggtgctgtgacacagccaggatctgcactgaacatgatcatcaacatttataaagtagggccggtcattgttgcggcattagcggtcatcacgctttcgttctacaaactggataaacagtacgattcgattatgaaagaattgatcgaccgtgaagccagaggtgaattgtagcgacttcttataaaataaaaaacaggctataaaaatggcggggtttttatcacaacactccgccagaagcctaagcgatttgtacataatatacttgattagttctgtcctttattttatgtattcatacactgagatgttcttttgaaaattgaagaatccttcagaatcaatgcatctccatgaattagcaaagcttctactaaatgagcttttaatgcaacctctattttagatatcattgagaatatcaggtcagagagcttttgatcgagacgatataatgtcagaatatcttcaaatttggttcccaaaatatattttttggtagagttattatataattgaaacgaatatcccctcagccgataataaccaattatttttaatgctttttctgcatcctcttgagagacaatctccatatctgaatcaatgtacgattgtatttgctgcgttatcgttaatatttgttttggatactaatacatgaaacactctataaatgaaaaaagtcccaccgggttgcgcatagaaatcagaggcgtggtgggctctgttaatatcattatacaatttcaatcatatttacaaatatttgtttattaaattgtttaatttacattataaataagagagccaaaatttattataaaatagaaattttggctctcttattgtaattttatgctagttattttgtactcttctcaaacgccttcataataagcaccgccacatatgcccccggatcttcaagacttctggaagcctctcccctggttgcggcgcgtccgtgaaccgcaagcatggtggtcgtattcttgaaaccgtcctctgctgcctttactgcaccggctgccatctcttccagaggagcacccgatgccgcagcggcattcagactttccaccgccgggtggataccgtcaataaacgtcttttctcccactttggcttttccgcggtttgcaacacctgcttcataggcctcaaaaagctttgccacatccgcattctcaagcatttccgtacccttcaggactttgcccgcctgcataagtcccgaagccatcagtgtgcccatcgtagacggcaccgcagatgccatggcctttccggcctggtataaaagctttccggcatccgtaacggaaccgtctgcgactttctcataggcggccttaaatccatcccccatggtcagtcccaggtcaccgtctcccacgatgctgtccatctcgatcagatgatccctgttttctgccatgatatcactgatctctttcaaaagcctgattaaataactattgtccatccttaattctgcctcctcacttactggcggaagaacggtgtcttcgcatcactgtccagcatctctttgagctcgtcatccagcttcagcagagagattgaaaatcctgccatctccagtgcagtggcatactctcccacataatatctgtgaacactgattcctttttctgagagcacctcgtcaatgtgacgggtcacaatatactgttcatctaaagtggtggctccaaggccgttgacgaggacagccacttcatcgccgctctcatacggaagatccgcaacgatctgacctaacatctcatctacgatctggtctgccggctcaatttttccgcgtctgataccggtctccccgtggatgcccataccgatctccatctcatcttccccgatggagaatccggcttttccgactctcggcacgacacaaggggtaagggcgactcccatagtccgcacattggcatttgccttgtcggcgattcttttcacgttatccagatccatcatcttgtctgcggcagcccctgcgcatttaaatacaaagaaaatacctgccactccccggcgggtgctcttctcacccggtgcggaaggaccggcagaagccacatcatcggccccgagaacggtctccacgcggatatcctcttccatgtccgccatctcggccgccatatcaaagttaaagatgtctccgttgtaatttccatagatatagagcacgcctgccccgctgtcgatctcttttgttacggcaagcatctgttctgcactcggtgactggaatacatcacctacgcagcagccatccagcatgccctctccaacatagccaaggaacagaggaaggtgtccggaaccgcctcctgtggcgatgcctacttttccttctttcttgtatttagacacaaggcactgaagatcatcatccgtgcaggtcaccatgtctttgtgtgcgatatagatgccgcttagcatctcttttagataattgtccggctcattgataattttcttcatctctcacactccttatttatttgggaatttaatctgtgaaggatatgcccagctctgtaattcttccggtgggaagtaatccggctcctgtcctccattggcagcaagacagttaaagtataactgagccagttcttcgatgtaggaagctttcaggtaagcatcgtaaatttctctgccgtctacagcaacagcgccgtgtccctgcagaaggaaacagtctgcttcctgaaccggttcaatgacactgtcagacaggtccgtggaacccgggcgtccgtatggagctaccggaattcttgacttgctcactcctaagtttgcaacttcgtatacaacagccggaatcggttttttcagcactgcaaatgtggtggcgtacattgagtgtgtatgtgctatcgcattgacatccggtcttgtcttatagatctgtaagtgcatcagggactcactggtaggacgcagtccggaaagattctcaacgacattggcatccaagtctaagacaaccatgtctcttgccgttaaaagctctctgtccacctgagtcggtgtaatgactacatagcctgtttctttatccctggcactgaagtttccggacaaatgtttgcataatccgtccttctgtgctctttttgcaatctggactacatccttttttaatgattctaacataatgatttctccttttctttttgaacaatggtaaggatctcttccggctgttttgcctgcttcagcttcttcaatgcagaagggtcctccaggatctcattcagctgaaataatacccctaaatgattggtggcatccggagtcccaagaactatgacaatgtccgcgtttaaatacccgttgatgtcaattctttccggaagctttaacaatgaaatacaaatccgtccggctccgtcctccactcccgcatgggcgatgatgactccgtcagcgatcataatatatggcttgtcttcccggatgatctggaccatcctctctacatagcgctgttctatatctccctgtgcaagcagcggagccgacgccgtcctcacggcatcttcccattccatgggctcctctgatatttggaccgtttcctttgtaagtacatctgccagcataggctgttctttcatctccgccgttctttctgcagttccctgaacatttacagggtttaaaactctgttgatctctctgaccagcgcgtcccggtcctcaatgactgcgtgctgttccacagcccttacaatttctgtcacatcgacttcgtgaggcataataccgttaatctcactcaataccttttccctgaatttatgcttggaagcttcatcgagaaatggttttacaagaaactgaagtttatccgtctccagacggaccatagtaaagactaattcaaattcttctttgtattcggtaaaatctctcatagaaaggcatgtgaggaactcgatctccggaaacagctcccgcagtgtaaaaaataagaagttggaaaccgacaccccattggcacagacaattacagctctttttttctgattttctatgtccaggattccttctctctgaagccatgccccgaagagtgctgtaatatagaccagctcttcatcgggaaattcacttccagccagttcctccagaggtttcatggaccgctttaccatggcgtgcagggaactgtatctgggaagtaccatgtctacaatactctgttcgatatgatagtggtatttgaccctgtaaaacgccggcttcacatgctgaaacagagcttccagaaggatatcccgctccttgatgttgacgcatataatcttttcaaaattgtcgatgacctgcctggccgcctccatgatctccacttcacttctcagattatccgactggaacctgtgatagttggaaatctgaatctgcgcggcaaaaaagatcttttccgtctgccatgccacatcgtgctcttttgcaaattccaccatgacagaatactcttttgtcccggcaatatgctgaaaggattcaggaagatcttccaggattctccctttcttgatgcggatcagcaccagacagagaatataaggaagttccctcagcctttcatcggtaaaacggatctttaacttattctcaatctcactgatctgcccccgcacctgctccatgagttccggatcgacctgggaaatctccagaatggcttcctgcccgttcggcatatttaggatctgccgcacaatcgggatcatggcctcccgtttgcagaattcacttccggccagatggtatccgtcctgtctgctgtaatggattccaaggccgtacggcgccagcctttcctccagtttcttaacgtcgatcaaaaatgtattcttgctgatatccagctttgatgtaaaatggtaaattgataattcttcccttgcgcacagaaggatcaggaagatcagcgctccccgttctttgtcggagtacacataggtactgtctttgatcccaatatcctcggtctggtactgttccagcacaggaaccggtatcacaaattttccggtgcgcagtctttctatcttgggcagtccgttatccgccaggtactggttgatcttatccatcgtatagctgacctgcttcctggacaaatctaatgactgctccacttcctttccagttatagacggattatttacaattgtttttaatactaaatagcctctttcgtctaaatacactagaatccctctttcatcgttccgctgctattttgtaacctcaatgcctggtgattttgcctcgtaatccagcagttcctttaattcatcgtccaggcgcatgacagtcagcgcagctccgttcatgtcaagggaagtcacatagtccccaatcaaagtcttataaacggaaattcccttttctctcaagtatctttcaatttcatcgtacagtacatacagttccatgaccggtgtcgccccgagaccggaaagcagcaccgccgcctcttccccttctccgagttccaagtcgtttactactgtctcagccatgttctgtgcaatctttgcggcaggctccaggtcctgcacattgatgcccggctccccgtggtgtccgatccccacctccatgcttccttcttcaatatggaaattaggatgaccaactgcgggtatggcacatggacttaatcctacacagatacttcttgtattgtccactgctttttgggcagatgcaatgacctcatccaggtctccgccttttgctgccctggctcccccgatcttccacataaaaacgccgcctgcgatcccatggcgtttttccttcgtttctttcggagatgaagccacatcatcgtttgcggttacatactttacagtgacaccggcttttttcgcttttcggacagccatttttacattcatgttatctccggcatagttgccgaacaggcaggcgacacctttccctgcatctgcttccataaatgcatcgtagaatgcctgggctgacggcgaagaaaaaacttcgccgactgccacagcatccaccatattctttccgacatagccaagaaaagcaggttcatgtccgcttccgccgcctgtcaccagaccgactttcccttctaccggtgcatttatgtattttacgacacggtcgttggcctcagacttgacgataagatccccgtgagcctttaaaaaccccttcagcatatcttctacaacgtaatccggatcattcacaaacctctgcatatttctatctcctcttctatgtccttcaaattagttgttggcttcctgttttgcctctttagttagacttctgtagtagaatacgaaacataccacccagacgatcaggatcaccagcggaatgaattctccgtccagaattttaaatacgtgtgagaaagcataggtctgaatcggtccgtcaatacaactgttggagatcatttctcctgccttcaatgatacggctcctgttgtccgtgccaagtctgtcataaacggtgcaaacgcagtaccaacccataagaagaccggtgcaaaaatagtacacagaatgatcatacggatcagatttcctcctgttacaaggaaggccggtacagcaagcgcgatgttaatgattccggcaaatggaagaagttcattgcccggaaggaacattgagaataacagtgtgatcggcacagaataaataactgccagccagatctcattggatcctccaaggaatggccagtcaagccctactaccaaagttcttcctgagaatttcttgttcatgaagtcactgactgcctctgaaatcggagccagagcctgcataaagtattttgtaataaccgggaataaggtcagggctgttgctgccttgatcgccagtgtcaatgtatttgcaacgctgtatctggcaagaactccgaaaacgataccaaggatgaatccaaggatatggttttctgcaaaaattcccaccttgtcttttaatgctgcagcatcaaactgtttatttaaggctggtaatttctttaaaatacagtcaattggatacattacagctgccaggaacgtcattttatgggtacaggtaacacccggaattccggaaagtttttcaattctgtgctgatgcatatctgcagcctttaattcaaaaacgatctggatcgctgctacaacaaatgcacaggcaatagaacctgccgctccgaaatgtggttttgtaatggctacaacagcaaccgccgtaaagatctttccccatacgttccaaagatcggcgttgaatgtatttgtcttattaatcaccagcataatgacattgatgatgatcagcagcgggaacattaagaatgcgtacggccaggaccatgaaatcgttgacatggtcgtccaccctccatcgacaatcggcagtgcaataccggttgatttaagcatcgcttctgccgccggacttatagtttctgtcatgaaggaaatgagcatcgtcattccggtaaacgccacacccagtgtgatacctgcggaaaccgcatcttttactttcatccgaacgatcagtccggcgatgataataatgatcggtacgaaaatcgcagcccccaaacctaatagataattgacaactgaactcaatacttgcatacaatctctcctttcatcctcttatgatgtgtcttttgtagtttttctcctcttatttacatgcctcgatcagctttttcagttctgcatcctggcctactccggttaagaatgcgattccgttgatcaccgggatcggatactccttgtcaatctttgtgatcgcgatatatgccacgctggaatccatatagcggtctacggattttaaatctaccgcttccacctgagcgtctaccttattttcttttaataaacggttcaccttgcttgctactgtctgagatgttgctactccgcttccgcatgctacaatgatctttttcataatttttatttcctttcttgagataaacccttaatttcatttactttcattcagtgtttagagtcctttcatggaaagaattgcttccatatactcttcttcggtttttgcatccataaggcgtttcatcagggactcatcctggaagtttgccacaaggatctgaagcagttccacatgctcatcagaacgcttaaaaccaagcataaagacaaacttcacatcatgttccacatcgtttgccgccatttcacaccacttgaccggttcttttaatctgaccggcgcaatgaatggctttaagatgtgttccggatctgcatgagggatcgctaccggatacggctctactgccaatgccgtcgggaagtttttctcccttgtcttgatcgcatccacgaatgagctctttacaaaaccaagttcttcaagttttgcggccatcttgtcaaaaaagtcatcggtgtctgccgcttccatatccagctggatcaggtctttgtaaatcatgtcgcgtttcaaacattatcactccttttctttttattttcatttcgttcttagtactcttaaattgtaaccctgtaatacccactaaaacaatctgaattgggtcccaaagttgctcattgaattgctcatcacaagcatgcgcaatccgattgcgcaacgcactgaacaatataaatccgtgcaaaaaaagaagacaatccccagaatctcatctgagggttgtcctctaaatcttacggtgacagggtgtcaggcctgttttgtctccatatattcattcagtctgccgagaagttcatttacattcattccgtgcacaaaagcagcttcttccagtgtctctccctgtgaagacgggcagcccacgcagtgcatgccggatgccattaaaatagccgcgaagttttcatcgatggcaagcagatcaccgatcaccatgtcctttgtgattgtattcatttataatacctccattcttaacagtcgccgttcttctccataaatccctgaagaagaatcttatttagtataatacattataattaaaaatacaataattcaccggaattcccttgatattgtatattaagtatattaaaatgaaaagtacctggaaggcgggtcacccgccatttcatacacaactttttaaaggaggaatatagatatggcatatgtaatttcagacgcttgtatctcttgcggagcttgcgaaggtacttgcccggcaggagctatcagcgaaggggacggacagtacgtaatcgatgcagatacatgcttagactgcggagcttgcgcagacggatgtccaaccggcgctatcagccaggaataatcgatacataaaaagagatgccgttcggcatctcttttttgtttaagaaaatttattaatcgcggtttctttttttcttcttaaaaaagaatcctctctcttttgtagctgcaatctcttctctgctctgctgctgcagacggatcagctcgtccagcttctggaatctcttttcttccgattcctccttctgacggaactgataatccatttcctttgccacctgtctggtaacctgatcgccgatttcccggctcagctgatttttctgttcgtttaaggcccgtcccataatcttaaccataacattttggaactgttccattttatcctgcggacccacactgctcccgcctgcgggaaagggaatgacattctttggcagagcctccttgatttcatccatgctcatgccctcatccctcatatcacggatcttcataaatgtatgtaattctttttccccatagtaacggtagcccttgtcattccgcggaatgttaagcttcagctcttcctcccaggcccttaaagtataggtttctaaccccaattctttggctgcttcagaaatcattcgtcttttttccttcataagtcccttcctttcttcttatttattataaggtgggggctctttgcgggacaagaaaaaccgccctctaaaagacgacggtttctatcataatctgcaggctacatcctgactctctctttatttccaaacttcgtatactgtcctaaccagacgagttccacacttcctgtggaaccatttctctgttttgccacgatgatctccgcaagacccttcttctcagagtcttcgttgtaatagtcatccctgtagatgaacataacgacatcggcatcctgctcgatggaaccggattcccttaagtcggaaaggacaggcttcggcggtttcctctgctccaccatacggctcagctgcgaaagggcgatgaccggcgcatccatctccctggccagcgcctttagggaacgggagatctcggagatctcctgctgtcttgactcagactttttccctccggacatcagctgcaaatagtcgatgatgatcaggcccagcccgtaagtctgcttataacggcggcatttggaccttaattccgccacagtaatacccggggtatcgtcgatgatcagaggagaacgcccaatggtcccggcactctccatgatcttctcccactcggtctcctgaagctctccggtacggatcgcctgggagtccaccatggcctccatggagatcatacgggtcaccagctgttccttggacatttccaggctgaagatcgctgtgggaacctgtttcctaaccgcagcatgctgggcgatgtttaagacaaatgcagtcttacccatggcaggtcttgcagccaccatgataagctccgacgggtgaaggccggtcagcttaaagtcaaggtcatcaaaccctgtggcaaccccggtgatccttccgtcggatgccgctgcctcctctatgctctccagcgtatttaacacaacctggtcaatagagacaaaatcctcacggccgctggcttcctgcaaaagtccgaacacgtctttttccgtcttttccaggatctgcggaacctcttcctttccgagataacagtccttcgtgatctcctccgtcaccctgatcagcttccgcagggtggacttctccttcacgatctgggcatactgcttggcgttggcagacgtgggaaccgcctccagaagatcccttataaactccaggcttttcatggattccggcacatctttttctttcagcttattctggagagttaccagatctacgggttttccctccttgtacagctctgtcatcgattcaaacaaaatcccgttctgcttctgataaaaatcctctttggtgacaatatcggaaacatcagcgatcgcatccctgtccatgatcatggcacctatgacagactgctccgcctccatgctgttgggttgtattttcttgataaatgcctcatccattgtctttatttatcctcttgtacttttacctttaatgtggcagtcactttcgggtgcactttcacctcgatattgtgtaccccgagtgttttgatcggctctgtgtgcatcttctttttatccagatcatagcccagctgttttttggcggcctcagcaatctccttcgtggatacggcaccaaaagttctgccgccctctcccactttcatcttcaggatgacttccttctccctgagctcttctgcaaacttcttcgcctctaaaagcttctcttttgccactctgtcttcattggcctttttaagcttcagatcattgaccgcttttttgctcgcttccacaccgagtcccttgcgcaggagcacatttcttgcgtatccgtcgttagcttccacaatatcgtctttctttcctacattttttacatcctgcaataaaatcactttcattttatatgtctccttcctctttcataaactgcagagtccccttgatgatctgttttgcgtcatacagggacacatccaccatctgggcaccggccacggtcagatggcctcctcctccgaactgctccataatcttctgtacattcacctcgtcaatggatctggcactgacatagacccgctcttccacgccggtcagcacaaaggatgccttgatcccgtcaatatctaaaagttcattggccacctgggccccgaccaccgtcggactgtcgatgccaatccccaccagagtggcaatggcaaaggaaccatacataatctcagcatcactcaccgccttcgctcggattctgtaagaatccatactggtcctggacatcttccgcactttatttaaatctgccccgctccgcttcagaaatgccgccgcctcgaatgtccgtacccctgtcttattgacaaagttatcggtatcgatcagcatgccgaagtacatggcattggcttccaccgggagaagttttggtttcgtagtgatatactgaagcacctccgccaccagctcacaggtggaagaagcgtaaggctcaatataagagagaaccggatacttgatcgtctcttttccctttctgtggtggtccaggatgacgatcgtattggtctgttccagcagatcttcacactcggtgtagcttgcgtgatttacgtccacaacgatcagcagggtgttgtcatccgtgatctccctggccgtatcgctggagataaacatgtcctcgtcgtattcctcacacgacagcagttcttccatgatcggtcgcacggaaattgtcacctcgttcatgacgatgtgggcctttctgcccagtgaaagccccaggcggtataatcccaccgcagcccccatggcatccgggtcgggtattttatggctcataataactacattttctttcgactccagaagttccctcaatgcgtgggccttgactctggctttgactctcgtattcttctcaactacggcggcgttctccccgtaataggaaatatcctcgccgtctttgatcaccgcctggtcgccgccccgtccaagagccaggtccatagccgtgcatgcggcctcatagttttcctggtagctctgaccgttgatcccaaggctgatgctcagcgtcatattaccgctgcttccaagatttatactcttaacttcctccaaaatgtgaaacttccctgccttgactttctccagatacttttgctgaaatataatcaaatacttatctttctccgtctttttcacaatgccggaaatattctgaataaatttattgatcttctggtctgtcagcgccagaagcatggactgttttacttcatccacgttgtccagaagttcctcataattatcaatatagatcagtccgaccaccatccgctgattttcgttctgctccatatacatcttgagcatggtctggtcaaagatataggcggcaatcatcgactggtctctgagccactgttttgacttgctctctgtctcctcatcaatgagactgtccatctggatcctcacgaattcgattttgtaaaagcaggtcttatcctgatccttttcccggctctctctcttcacatgggagactgcgtgattcatctccgacggaagcaggttcttgtccagttcggggaacatctgctgaagcttggaaatgttcttcccgtccaaaatcttttcaaatgcctgattataccacatgatatccccgtccccgccgatcagcacatagggaagaggcagctctttgatcaaatggttctggacccggctctgctcaaatagaaagtccatcgtctcctgtgtcatcttcttcttataatacggataatagatcacggaaaacaaaaagaagatcagtacaaaacaggccaggatgatcccggacttcacgtcaatggaaaacaccagaatgtctgccatcaaaaacaacagtccggccagaacgggccagacaatatctttgctgacgcttatacttgtattcttatttttcatgatacggctccttaaacctcggattcaaatattgtatttttcattatagcatgactggcaggcaaggtcaaaaaaaccgccatatccatagggatacggcggcttgtcttttattagtcctgtgtgtaaggcattaaagcgagatgtcttgctcttttgatcgcgcttgtgacagctctctgatgctttgcacatgttcctgtgatacgtctcggcaggatcttgcctctctcagaaacatatttctttaatgtcgctacgtctttgtaatcgataacggcatcggcttctgtacagaatgcacatacttttcttcttctgcgtccgcctcttctcctgttcggagaatcacctctattataagccatgattaaacctcctaatttaactaaatggcagttcctcttccaatccgtccggaatgttcataaaaccgtctcctgcggcctggctcggctgcggcggtttcgaaggatttgctgtctgcattcctcctccgttgtactggtccgttgccgctttgctctcgcagaaatcctgttcttctacaataacatcggtggtatagaccttgattccgtccttgttggtgtaactgcctgtctggattcttcctgagatgacaatcttgattccctggcggaaatacttctcagcaaattcgccggcacgtccaaatgcgacacagttgataaagtctgcatccggttcgccatccctcttgaatctcctgtttacagctaaagtatatcttgcaactgccgtcgctctctcaccctgtgagtatctcacgtccgggtctctggtaagacggcccatcaaaatcactttattcatattggattcctcctgcctaccaaagtgttaggcatcctgttttacgactaaataacgtaatacattttctgtaattcgaagtttttcttctaaaacagccggaacttctgtctctgcgtcgaactggatgaagtagtagtatccttctttcatcttctggatctcgtaagctaaacgcttctttccccattcatcgacattcgtgatttcagctcctgcttctgtaatcatagcttttgctttttccactacttccgctcttgcttcgtcttcgatcttagcattcacgactaatgcgagttcatatttactcatgttatctgcacctccttctggtcttttcggctcttgatcttctgccaagagcaaggataaatttatatatcacaagttgatatgttaccataaattccttttaaccgcaagcttttttcacaaatcccctgaaattcttctccacgagcttcctggacaccatcacctgacgtccgcagcccatacatttcagccgaaaatccatgccgaccctcaatatctcccactcgctgctcccgcacggatgaggttttttcatcttgattacatcaccgatctgaaattccatacactgcctccttttctcaaatctttacgaaaaaggcagccggatcatgggctgcctttcacaaagagctgtattactttttcttctctgtcgttgctttctgctttgctgtggttgtggcttctgtggtcgtcttttcggtagctgtggtcgttgccttatacttaaatgtgatctttttccacagttcctgatcgatgctcttgtcatcgtcccacttcttgtctgcatccttcgtccactttttatataccttctggtatgcttcctgctgtttttcctgcagaagcgtactcttggatgtggcaagctcactctttacattcgggttgagcatcttgatgatgacatacgcatcgtctgtctcgactacgccgctgacctgattcttctttaatttggaagccgcatcttcaaacttggttccgagaactgcttttccctttgtgtagctttcttcgttgtctgtatcgactttatactttttggctactgccttgacgctctggcctttcttgatcgcctttaatgcttctttggctttctttaactgagctgccttttcttttgcagtcatatttacttctttgccggtcttgctgtctgttttcttcgttgtaaaaacaagcttgtatacttttacggtcttcgcttcgtcgtctgtcactttcacatctgccttttcgatgatcgcattcataaccttctgggcaatcaggttttcctgctggatctctttgatgtaatctttatctgccccggtcaccttcatcacacgttttccaagttcatttttagtaaaagatttgacggattcgtccagctgtttcttctcatcggaagttagctttaccttgtagtcatctgcgtggtcagccagtacttttacagtcttgatctggttgatgacattgtctttaatagaatcctgcattgtgatctttttgccctttttgtcggtgccgacctgggtagaccacagtttatctcccagataagatgcgtactgctgctctgcgctgtactgcatgattctggcatatacatgggcttccttataggtcacctcatttcctgcatattcaaacagcgtcttgtcatcctgcttcttacagcccgctaataaggccgcgcacaaagccataaccgccgcaagacatacgatcttcttcgctacacgtttcattcttcgtttcctccgtttaatttatttccattttggattatactacattacgatctgataatcaacgcatccaatgagttcacacaatgttcaatctttgatagccatgcgcttttcttcgcggatgaaagatccagtacgaatacgggatgctccccggcactgacggagagttccttcggaaattcgctcagcacatccgggatcttctctacctgcacgtttgcctccggattcatctcaaaggatactttctctcccttttgttttacatcggtcatataggcatggtgagccatcgacttcagcagggcgatatggagcagattgactaccgctgccggcagatccccgaaacggtccaggagctcatcctgcatatcttccagctcatccttcgtctcgatggcagatatccgcttgtaaagctccagcttctccacttcgtttctgatataggcagatggaagaaaggcatcgatgttcagatccagtgtcgtgtcaaaatcagtatcctctgaaagttctcctttcagcctcagcaccgcgtcgttgagcatcttacagtacagatcatatcccaccgcttccatatggccggactgctcttctcctaaaagatttcctgctccccggatctccagatcccgcatggcgatcttgtatcccgatcccaggtccgtaaattcccggatcgcctggagtcttttctcggctgtctcttttaataaagtgtcccttttgtacattaaaaatgcaaatgcgttcctgttggagcgtccgacacgccccctgagctgatatagctgggaaagtcccagctggttggcatcatggatgatcatcgtgttcacgttcggtatatccagcccggtctcaatgattgtcgtggagacgagtacgtcgatctccttttccatgaactgcatcataatattttcaagctctctttcccgcatctgtccgtgggcaaaggccacttttgcatttggcaggagtttctgtagctcactcgtgatctccgcaatgttgttgacccggttatatacatagtatacctgaccgcctctcgtcatttcccggtggactgcctcttttacaagctcctcattatactccatcacataagtctggatcgctctccggtcgtggggaggttcctccaaaatgctcatatccctgatcccgatcagactcatatgcagcgtcctgggaatcggtgttgcggagagagaaagcacgtccacatctttcttcattgtcttgatcttctctttatgtcccacgccgaaacgctgttcttcatcgatgatcaaaagtcccaggtctttgtacttcacatctttggaaagaagccggtgtgtcccgatgaccacatccacgattccttttttcaggccttccatcgtctctttctgttccctgggagtacagaatctggacatcaccctgacagtcatcggataattctgaaagcgctcacagaatgtattgtagtgctgctgggcaaggatcgtagtgggcaccagatatgccacctgttttccgttggttacagccttgaaagccgcccggatggcaacttccgtctttccgtatcccacatccccgcagatgagccggtccatgattttggtgctctccatgtcccgcttcacatcctctatggcattgagctggtcctgcgtttcctcataaggaaacatttcctcaaactctctctgccaaactgtatctttatcatagacatacccttctttggcctggcggaccgcatacagctccaccagctctttggcggtttcccgcacctggcctttgacccgcttggtagtcttcttccactcattgcctcccagcttgttaagccggggcttctttgcattggcgctggcatattttgcgatctggtccagagcagaggcaaggatgaacagattgtccccgcctttatactcgatgctgatataatccttctcgacgttgtttacggtgattttttcaataccccggtagattccaacgccgtgcttttcatgaacaacatagtcgccgatggaaatatccgcgaagttctttatcttctcgccttttcccttaaaggcggctttcttcctgcgtttttctttccttccgctgaagatatcgctctcggagatcagcacccatttcgtctccggatattcgatgccgctctttaatttgcccggcgtgataacgatctgtccgggaaccatatcttctgaaggtttcttatcgtatgtgacagtcagcccgctgtctctcatatcctcggccaggcgctttgccctggttaccgaaggggagacaacaagaatccgatattcttttttctgatatcttttcagatccttgatcagctgttcaaagctgttgttataggactgtaccgactttgtctctatgaaaaacgtgtctgtcaccttcgctgccttcacttcagatgccagtgaagataaaaaggccaccggctgtttcagcagacggttcagtgcctcctcaaaacaagctaccgtgtccatctgtccaggcagcagatatccggcctccagacggcttttcatgctctccgtaaactccaggaagaagccccgtcctctctcttccacatgctgcggctcatccacatagaccgcggtatctttcgggaaatagtcgagaaaacacaccagccggtcataaaaatacggcagatatccttccactccgatgagcatggaaagttccgagagttcttctctgatcctctggtattccttcgtgagtctgacctctttgtccgtctcaaaggctttatgaaacgtctctttcaaatcctgatattcggcctcgatctttttcagtccctgtgagatccgttcttcgcttaaaacaatctccgtggcaggatagacagtcagactctttacttcttcaatggaccgctgactctgggcatcaaaactgcggatcgaatcgacctcttccccccagagttcaattctgtacggacagtccgaagtaaacggataaatgtcgacgatcccgcctctgaccgcaaattctccggccgcctctacaaacggagtcctctcataccccatagcggtaaattttttcgtaatatcctgttcggaaacctctgtctccagactgatcatcacccggtttttcttgatctccgcaagaggtacaacccggtccatcagggcgtcgacagacaggacaaagacgcctccctgtcccttgataatactctcgatccccctgagccgctcttttgcgatggcatttccgtggacgtcagcgctgtaaaacagcggatctttggcaggaaagtagacggcgtcttctccgaagaaccgatagttttccacccactccttggccttattctcatctgctgtcacgatcactttatagctgccgcgcttcttttttcctctcagtgcactgaccagatgggcttttgccccgtccgtgcatccggacactaaaacagggccctgattgttctcaaggcctgtttttatctgttcaaacactgcatcattctcaaaaatatgatctaacacgtctcattccttactttctgctgcggttacttcctcgcttttttattatattggttcattgccccggatatgtcatccatcaccataagttttaccgcatcgtccacatccggaaacacatcatcataaatttctatctcacctttggagaaatggcccagcacataatctgccaaatcgtatcccttgggcttttctcccacgcctatttttatccgcgggaaatccatgcttcccagatggctgataatgctcttgatcccgttatggcctccggcgcttccctttctcctgatcctgagctgccccacatccagagaaatatcatcgaatattacgataaagtctgaaggctccagcttgtaaaagtccatgactccccggaggctctccccgcttaagttcataaaggtctgcggctttacaagcagtactttctgccctcctaagtatccgcttccgatgagtgccttatgcttttttgaagaaatttctatctggtttttcccggcaatataatcaatggctgcaaagccgatattatgtctggtccgttcatactgccttccgggattgcccagtccgacgattactttcattttgctgctcctttgtcctgattccttttcttttcaaataagtctggaaccagtataacaaaagattataaattttgaaagaagtctcttgttttcgtcaccttctgcatcatatggtcaaattcttccggtgtcagtgactgcggtccgtcgcagagcgctttcgccggattattgtgtacctctaccatcaggccgtcagcacccgctgcgatggcggcaagagccataggctctaccatgaaacggatgcctgtggcgtgagaaggatctacgatgaccggcagatgagatttcttcttaatcatcggaatagcagacagatccagtgtgtttctcaccgcagtctcgtaagttctgatcccccgctcacacaaaatcacattctcgtttccccctgccatgatatactcggcactcatgagccattcgtctatggtgcaggccatccctctctttaaaagaaccggtttgtcaatcttaccaagttctttcagcagttcaaagttctgcatatttcttgttcccacctggatcaggtccacgtcctcgaacagtgaaaggtggctggcatccatgatctctgtcaccacaggaagacccgtggcttttttagcctccagcaaaagcttgagcccctcatcgtggagtccctggaaagcgtaaggtgacgtcctcggcttaaatgctcctccgcgcagaagacctgctcctgcttcctttaccttctgtgccacttctgtcatctgctctttcgtttcaatagagcacggcccggcaatcacctgaaactctcccccgcctatctttactcctccaatatctacagccgtgtcattcgggtgaaacttcctgtttgccttcttgtatggttcctgaatccgctgcacggtctccacaatgtcatttgccatcacgtggtccacatcgaccttggaggtatccccgatcagccctaaaagctgtgtattgattcctgcggattcatgaatggcaaaaccctgggataccatctcctcctttaatgcctctatctgctgcttcctggcgtcactctttaaaataatgatcattgaatttttcctccttgaaaataaaatggatatttgccttgactgctgcaatgcggtaaataaaaaggacctgtatcccactacaagaatacaggtcctaaaaatgaactttaccgacgatgtttctaccgggtttcaggagatgattcattgtagcgcaaaaagccgggattaaaataataaccccagaaataaaatgaaaaaccatatgtatttgtcattttaccttttgctgacatgagaatctcctgatattgatgctttcgttctgaattaataacttttgtctatcaaaccaatagcttatgtctattaatttacacgattgtctcatccttgtcaagttaaatcgtcctgtactgccacttgcctcttatgtaccggataaagaaaagcacggcccgtacagcccagtccagtgtcattgccacccagactccaaacactccccatccgagccatttgccgaggacaaagctgaaaaagatccggaagatccacatggaaataatcgcggtgaccatcgtgtactttacatcattggacgccctgagagtattgggcaaagtgaaggaaaccggccagaccgtcacacagcacagcgtgtggtacagcaggatcttcctcgtaatggccgcggtctccggcgacagatgatatgcccggatgatcacgggaagcatggcaacaatgaacaggttaaacacaatcagggaagcgtatgcgatctttaacagtttttttgtataataccgggccgcctcataatcgctggcacctacacatctggatacaaccgtcagcactgcaagccctacggccattcccgggatgatctcaaacatagccaccatgttgctgaccgcattggccgtgatggatgcggtcccaaacccggccaccagacttaaaacaaggatctttccaagctgaaacatactgttttccactccgttggggacgccgatcttcaagattctgctgaccaaaaagcctttgaatttgaaatgaaaatttctgctgatatggactgcctgattcctgtttttcaaaagcacaagaatcactgccgcagcgattacccgggataccagcgtaggaattgccgctccttccacacccattcccacaccgtagatcagggcagcgttgcctatgatattaatggcattcataaagagtgacatctgcatggctgtctttgagttccccatagtcctgaacaaggccgcacatccgttgtaaactgccagaaatggaatcgacgctgtcacgatcagaagataaacttccgcactgtgcataacggccggttcaatagccccaaaaactccgtgaaggataaagcctctcatagcataaatacccgccatgatcaccacagccaaagctgagataaataagatcagctgatctgcggtcttgcaggccatcacatgctttttctgtcccagatactggcctgccaccacggctcccccggtggccagtgccgaaaacatgttgatgagaagaatcatgatgctgtccaccagagatacccctgagaccgccgcctctcccacactggagatcataatggagtcggcaagacccacggtcaccgtcagaagctgttcgatgatcagcggaatgatcagttttttcaaatccttgttggtaaaaagtacctctcttttttccatcccctatttcttttctccgttttttctgtcgatgctgtcgaccatataagcgattgcctgatctcccgttatattgcaggccgtcccaaagctgtcctgggaaaagtgaagagaaatgatcagctggctcatcggatctgtaaaatgaagcatagatttgatgaggcccagagccgccatgactccgcctccgggaactcccggagctgccaccatagtaatacccagcataaaaatgaacggcaggaacatggacaatgtcggtgtcagtccgttggcgagcattatgcccatggaaccgatcaccagacagatcgtatctccggagagatggatcgttgcacataacgggatgacaaagtctgcaatatcttctgaaacaccgctgtccttactgctttcaaggtttaccgggatcgtggatgcagaagactgtgtacccagtgccgtaaaatacgccggcgcgatgccttttaaattcttaaacttattctccttcgtaaacagtgtggatatcaaaaactgaaatgcaatgtaaagccactgaaagatcaggatcatcacatacagtttaacaaacatctttatggtcggaagcagcttcccttcggctgctattttactgaacagccctgccacgtaaaatgggatcattggtatgatgatcttgtttaatgtcttggtgatgatctcctgaagatcttttaaacagagcagcagcgtatcatttttactgtttgcgattccaagtcccaaaaggaatgccaggatcagagccgtcataactccgaacaccgggtcagcctggatcgcaaagatggcttcaaaagatctggtctgaatctcactgccagtgatccggtgaatcagtgaaggaagaagtgcctttcccacaaaaaaagcactgatccctgcgatcaccgtagatgcgtatgcgagcagaagagttaccccaaacagcttgttggccttcttacccaggtcggccagtcctacggccacaaaagaaaggatcagcagcggaataataaaatttaaaaatgtactgaataatgtagtaaaagtaacaaaaagacggattacgcctttaaagataaacgtatccccgacgccaaatatatctccggcagagccgatcagcatacccgctgtgattccgatcagcagccgggtcagcaggcctaattttttcttcttcatataaaataattctccctatttttctttgttctgaacggcagaaaacagtctgccccgcaaaatactattatacgacgtgaaaaaaaagataacaaggggcaccaggattttcaaaaaacaaagtgggaaaggctcagaacttttctttgaaaatgaaaaagcaccagaccttcgtctgatgctttcagcagtcggggcaacaggatttgaacctgcgacctcgtagtcccgaaccacgcgctctaccaagctgagccatgccccgcttttgctattatattacgtctggccccaaaatggaagaggaaatttcatttttttttaaaattattgtatatttttcagtactttatttttccgtattcaataatgcctgaaaatcagaacccggcattggttttgcaaaataatagccttggatttcatcgcacttcatcttcctcaaaaactcatactgctcctctgtctcgactccctctgccgtgagacggatgcccaggcccctcgacagatcgataatgcttcttatgatcttctctcctttgctgtccccgatatcgtccacaaagcttttatcaagcttcagcacatcaatcggcatggagccaagcattgtcatggaagagtagcccgttccaaagtcatccataagcacagaaaaaccaatactgtgaagttcatctataatatttctcagcagcacctcgtcctctgacatgacactttccgtaatctccagcgggaccagcttcggagagatctcatactctctgagaatatcctgatatttgttaataaacgaactataaaaaatattataccgggacagattgaccgataccggcacggcccttcgtccctggtcgatccactccctctgctgccggcagacttcccggaacataaattcatccagtcccacaatcagtccattttcctcaaacacaggaataaaatccgtcggcggaataatcctgccgtccccggtgttccaccgcaccagtgcctccgctcctgccagttcttttgtctctgtatcatacttgggctggaaataagcacagaattcatgatgggcaagagcagtctccatcctgtcttccatctctttgttgtgaatgatcctgcttttcagttcttcattatagaaagcgtagtagctgtggatctgattttttaccgtagcctgagcaataagcgccatatctgacatggaatccacggacatgctccggtcagacacaagataaataccgatgctcggctttattttgtagttcatattctttatcttccggatctggctgcagaacttatccagtctcttgagcagttctccttcggagtgataatgcatgagtgccacaaaccggtctgcttccctgtgtgcagccagctcaccttcgcagagcatatcgccccataatttccatatgagacgtatgatctcatctcccattttaaatccgaacaggtcgttgaccagcttaaaccggtcaatatccatgcaaagaagcgccatttttgccgtatccttttcaagtgcgttctctgctttcagacagaaggccttataattatctccacctgttatgacatccgtgtaggcgatttccatgagtcttgtctgtttcttcttttcagatctgacaatataaatcaaaagaagaaggaagaccgcaacaacgattcctgactgcacatagttcagcttcatgatgttcatagtttttgtgttggcaacttccataggcacaactgtcaggagataccagtcattaatcccggtcggggtataatacatatattttttttctttgtttataaactcaatataaccttctttttgcttttttaatgcgtactttaacttatgagaagcttgtatattttggtctgaagcggactgaagggctttgaaaatattggtcattctctgaaaactattcttgttgtctgagtcgaccactacatctccgtccctttttacaacgtatgtatatccttccccgtagtaggtggaaatcgacagagctttcttaaagtcatccgtacggtaagccgcatacagtacggccagtactttcttgttccggatgatcggggtactgtaaacgttgattttgggcctttgggggtccagacggtcggtcagcgtcccggaaatcgaagaaatcccctttaaccctgactgaaaatattctctgtctgcaagatttccttctttccggtcacttgtgtaaacctttccgttcgtaagaatgatgcccatccgcttaaactgatacttctctgtaactttctgaaagctttgggcgagtttcttcggatctctcagcctcttttcactgatctcattggaaattccatccaaaagattgatctcactgagaatctcttttcttaaaatcttgacgctctgacccgagacctcatggagagaacttatcacttcattttccagattccgatgcagtgcacgggaatacacatagagagaagaaaacagaccaagagacagcacaattattaaaagcaggattcttttcatcacagaactgtctttcatgtatatgccctcctctcctctggcagattattgttatatgattataaatcatatagtatgcccagcacaatctttattttcatatgccaagctctgcaagctttttctccgtttgttccctgcttttaaatacaatcccttcatatccatatagttttgctgcggtaacattttcctccatatcatcaataaagacagattctttaggatggatgccgtacttatcttccagagcctgaaatatttttctctccggctttactgatgctgcttcaaaggatatcacttttccgtcagcctccgaaagaaacgaaaatggcttctcccgattctcaaaagctgtcttcccgtaattgctcagaatatacacggaataacccgccgctttcagctccctgatccagcttgatgcataagaatattcttcggtcatctcatgaatgtgctcatagagcaggttaatctgatctttatattccggcgccagcgaatagaatccttctataatttcccggtccggcatgcggctccggtcaaactctacccagtacggccctctcacggtcgcatcagccatacgctcaaatacttctccttcaaaacccagcctcaaaaataatctctcccacccaaaatctgcaagaacatttcctatatcaaatatcacatttttaatcatccgttcctcccgttatgtattcagaaaaaaatctcaggctcagcccttgttgtatactgttcttccaattccgtcttatggtacagatatccttcatcctcataatattttgcatgtttcgggcatttcttgatacaggccccgcatttgatgcagattccgtccactgtgcgaatatcttcacgccgtatagaacccataggacagacttctgcacagatcccgcagccgtcacagtctcctgaggttaagggcttcacttttctgatatcaataaaatttccttttctgtccctgggctggtaatatcctctgtatggctttcggttcccttttacatataccggacggctgtaatcttctttttcagtcctcttcaagcgttcgcaaagcccgaatgcaaactcccttataaggctcacatccctgtcatccggcctccctctgcccagtgtatccgaaaaagagtgttcgcccacgaaggctgccgctgccacagtatgaaacctgttctgttctaagacatcccgaagctcgatcagggcatcgtcatagtttctgttgccgtaaaccgtgacgggcaccgcgcaggcatggtttcccttgttatactctttcagaaagtcaagcagaacattgggcactctccccgcatataccggcgtcccaaagatcacaagatcacgcggtccaaaaacaagaagatcctttcttgaagcaggcagcgtaaagtcatattcacagtactctgcacgcagtgtccgggctgcctccccggctaaaaccgtcacaattttttttgttgtatctgtggcgctgaaataaactgcccagactctatcaatttccatcggccaatcctcctttcatctattatatcaactgcacgcagtgtttgccattgaaagaaaaaaatacttgaaccagattgactgactgaaataatcgtgggatacttatgatgacattttgaccagttctgcggcttgctgtctcaggaagataagattttctaactttcaacaaagtctctccggaggcccattcggaactcgctgacgctcagacagcctcactgcgcttcgcgcacctcctgcgagccttcgttgaaagaagaaaaactaatcttccttcgaatgcaaggcctccgaactggtcaaaatggacgtaatatctactggataagtatccatcaaacaaatagctttatccaacgatagttttttaacactattggaggaacgcattttaaagcgtgacaggaataatgataaaaaactcatgcattgaaaggtgatagaacgtatgaagacttcagatgatttaagatcgctgttagagcgcatcgaccataaaggctatcctgcctataaagacaccagggggagctaccggttcggcggatatactctgcatattgaccatgtacagggagatccctttgcctctccctccaaagtgagcatcagcattcccggcagaaacgccggatttcctgcccggctgtatgatctgccccataagcggatcgcactgcaggactatctgacccgcgttttcggaaggaaactggaatcctataattttaaggcaaagggttctggaaaaagcggactcatttccgtcagcagatgcggacaggagattttagagcggaccgccctgtccatccatcccgagtccggtgatatctctgtccattttgagatcggctttcccgccagaggccggaccatcgccgcttttgagctgatcaaaatcctgtttgattttctccccgaatgcgttttgtcttccttctattataagaagcttaacgcaggcgccctcgaagatgtgttaagccttgccgaagatcaaaaatatatccgggaccagcttcccaagctgaatctatgtgcttttgtggccgacggttctgtcctcccaagggagagcggtgtatcctcccgtccgatgaggcaggctgtggccttccactcgccggactccctgaaagtcacattaaatcttccttatcacggtcccctctccggcatggggataccaaaaggtattaccctgatcgtaggcggaggttatcacgggaaatcaaccctgctgaaagcattggaattaggcgtctacaaccatagaagaaatgacggccgtgaatatgtcatcaccgatgacacagcggtaaaactccgcgcagaagacggacgcagcatcaaaaatacagacatatctctgtttatcaacaatcttcccaatggaaaagatacggtttctttctccacggaagatgccagcggcagcacctcccaggcggccaatgtgatcgagagtatggaggccggaacttctctcttcctcatcgatgaagacacgagcgccacgaactttatgatccgtgatgaactgatgcagagagtggtccacagggatcatgagcctatcacaccgtttatcgagcgggtccggggcctgtatgaagaccacggtatttcttccgtcatcgtggcgggaagctccggggcctatttccaggttgccgaccacattttacagatggaccgttatatgccaaaggaaattacagactttgcaaaagaggagtccaaagcctttccgccggtaacacttccgaatgaaaagccggacagcccttcttttcaccgtgtcgtaaaacccagccgtacatccccaaaaaacggccggaataaaataaaaactctcggaaaagatgccttccagatcaacaaagagaccgtggacctgcggtatgcagaacagatctgtgactctgaacagacaacagctctcgcctatgctctgctttatgcccagctgcatctgatcgacggcaaaagagacctgtgccagatcgcagaggaacttttagctctcatcaatgacaaagggcttgcggcgatccttgacagcggatatgtaaagtccaatctggcaatgccgagacgccaggagattcatgcggcattcaaccgcttccgaaagctttagatcataaaaacatccgggatgcctgcagattggctgttcccggatgttttgttttttacattttcttctcaaacactttataagagattacataagtgagcagaaaaatccacatgacaattcctatgaccctgatcagtatcggataccacagacctccgatcagacagataagataaagtgctgtgatcagtccggtggaagcaaatctgtatgccttctttccgatctcctgatttctctcgtccgtattgctgaggcgcatttctttcagttttttcggatttttcaatatgagctgaaaccgtatccaaaggaccacggctgctgtcatgattcctgaccccacccccgcatatgttgatatcatatgttcattgatcttgacctcccaataacttcccgccaaaagtgaaacagccagtgccgctgctcccgctaagaacagtaaaatgagatatctctgctttctcctgactgccctgctgtattcctcatcgtttcttgcatttcctgcacaaaataatcctatcataagttttcctcctcctgatcaaatataaaaatatcctcgatcgttactccaaaaaactgcgcaatcttatgagccagcacaagcgaggctttgtatctgccgttttccagagagataatggtctgccgggtcactcctacggattcggccagctccatctgcgtcaccttttgatcctttctcaattcctgaattcttgttttcatatgcacacccttttttgtatagtttgctttacaattttagtatagctcgctttacatctaatgtcaagtgcattttacatttctctgtttacatgttttctgtcctgtgttagaatctttactatcactgaaattaactatgagaatggagtcttatattatggatacttataaaaaattcatcaaatattacggtccttacaagactgttttcttttttgacctgctctgcgccgccttcatcagcatcgtagatctggcatacccgcagatactccgaacccttacaaatacactgtttttaaaggaatcttccgtgatccttaaaaacatctttatcattggaggaattctgctggtcttttatatcctccaggcattatgcaagtattatgtaagctgtcaggggcatatcatgggcgcccagatggaacgggatatgcgaagggaactgtttgaacactatgagaatctctcattttcctattacgaccagaacaacacaggacagatgatgagccggttagtgtccgacttatttgatatttctgagtttgcgcaccacggtccggaaaatttatttatttccgtagtaaagatcaccggatcatttgtctttctgttcatcatccagtggaagctggctctgatcctgtcagccgtagtccttctgatgatcctcttttccgcccgccagaataaacggatgcaggccaccttcctggataaccggaagaaaatcgggaatatcaatgcaacccttcaggattctctggccggcatcaggatcgtacagtcctttgccaacgaagatattgaacgggaaaagttccatcagggaaatgaaggctttctcacgtccaagcgggataactacaaagccatgggaaccttccagggcggcaataccttctttcagggtatcatgtatctggtgactctcgtagcgggaggctgcttcatcgccgccgggcagatgacgcccggagacctggcgatgtatgccctgtacatcggtatctttatcagcccgatccagatcctcgtggaactcacggaaatgatgcagaaaggcctgtccggtttccgcaggttcctggatattattgagacagaacctgagatcgtggatctgccgggtgcagaaccgatcaccgatccggacggcagcatttcttatcaggatgtaagtttttcctacgaagacaatgaggtagtgctggaccacgtttcatttgaaattgaagcaggaaaatctgtggctttggtcggaccgtccggaggaggaaaaaccacgatctgttccctgctcccaagattttatgatgtgagcggcggcaccgtttcaatcggaggccaggatattcgcaggatgactcttcagagcctgagaaattccatcggcatcgttcagcaggacgtttacctgttcggcgggactgtccgggataatatcgcatacggaaaaccggaggcctccatggaagagatcattgaggctgccaaaaaagcaaacatccacgattttatcacagaacttcccgacggttatgacacttttgtgggagagcggggcacccggctttccggcgggcagaaacagcggatctcgattgcccgtgtatttttaaagaatcctccgatcctgattctcgatgaggcaaccagtgcattggataatgaaagtgaacgccacattcaaaaaagtctggaagagctttctaaaaacaggacgacgatcaccatcgcccaccgtctatccacgatcaaacatgccgatgagatcctcgtcatagatgaccacaccattcaggagcggggttcccataaagaactgttaaaacaggacggaatctacgcaaaatattataaaatgcagtttgaaggtttggaaacctttgaaatataaaacaatgaggccggacgcatcaaagcgtccagcctcattttatatatccacatggcaatgaatatgctatctcacgactctgccggcgcccccgcccgatgccagagtctcaatctctgctgcccgggcataattcatatctccgggtatcgtatgtttgagtgccgccgatgccgtggcaaattccagcgcccgctgaggtgtccagccctccgtgatcccgtggatgaaccctgcggcaaacgcatctcctgatcctacccggtcaacaatgtgtaccatataccgttttccccggtaaaggccgaaatcccccgcagcttccgctccataactgttatcagaagcagaaatgctctccctgagagagctgatcagatacgtgaatccatattgtcttcttactctctgcatatgttcttcatctacacagtcctcatagtctccgctgataaaatccatgcctgcctcttcatatccgagcaccagcgccgcatcccttgcatttccaaaacaaatgtccacataattcatcagttcccgcatgataccctgcttttctgggatattctctgtccagagtttggcccggtagttgaggtcaaaggaaaccgtaatccccatctctttggctgttttcagtgcctgaagagtgatctgcgccgcatttttgctgataaccggagtgatccccgatgtatgcagccaggatacatccgaaagcaaggatttccagtcaaaatccgacggcaccgcctctgccatggaagaacctgcacggtcataaattacactggacggccgcacagaaactccgttttccagaaaataaatgccgagtcttggaccgccgtaactgatcccggagcagtccactccggatttcctcagcacggctgccgcacattccccgacggcattgttcggaagctttgtcacgtaggagacctcatgtccaaaattagacagccctgccgcaatattggcttccgtaccgccgtaagtcacatcaaatgaagaggcctgaatgaatctttggtttcccggaggcgagagtctcagcatgatctccccgaacgtcattatttttcccattgtatcaccccttatttctggaccagatggactgcaaatcccccgatctcctctctgaaatagacagctccaagggtcccatccattttatacactgcgctttcttccctgaatgaaaaacctcttcttttaaaataacttagtgcccttccggcatcgttcgtcctcaccgcaatgtggcctttctcccctaaaaacggactcttcatagcctcaatataacttcccgcaaaaatggaattatcgttttcactcttctggaatccaaaaacagactcaaacattccagcggcgagcatggcttcatcccgattcttcatgttcagccctatatgggcaagttcaaaaccaagcatctcatggaccgcctttttagccatttccctgattgtgataaaatcgcctttctcaacgaggttttccggtaccataaacgaacctccacaggccgcgacctgtttaagctccagatattcccccatgttggcttccgtaatccctccggtaggcataaacttcatcccggaataaggtcctgacagagattttaacatcctgacccctcctgcagcctctgccggaaagaatttcacaagatgaagcccatacttcattgcctgctctacatccgtagggcttgaacatcccggtatcacagcaatgttatgccccatacagtattcaacgacctcatggttaaaacccggactgaccataaactttgctccggctttggctgcctcctctgcctgttctttcatagtaaccgtacctgctcccacgagcatctccgggcaggcttttttcatccttcggatcgattccacacaggcatcggtgcggaatgtcacttccgcacacggaatcccgccctcactgagggcctttgccagagccccggctttctctgcatctttaaggctgatcactggcaccattcctatactctcaatctcacacaaaagttcattcatggtatctgcccccttcgatccggttcaccggataatggatcgcttctccctttgcaaaccgcacggcctcctcggccgcttttcgcttaagttccatagccgcctcctcagaataccacgccatatgcggggtcacgatcagattctcattctcgaagatggaagaatccggcatcataggctccgatttcatacagtcaagagctgcccctgcgatcactttctcctttagtgcacggtcaaggtcttcttcattgatgatccctcctctggctgcattgacgatgaccgctgaatccttcattaccctgaatgcctccatatcaaacagattctggtttccgtctgccggacagtgaagagaaacggcatcggactgcttcagcagttcttgaaagctgacggcctctgcatttccgatccgttcaccctgatttaccatgggatcatatccgatcacccggaatccgagagctgctgctttctcagcaaaatttcttccgatacggcccagaccgacaacccccacggtctgttcagaaaaccggcggatcgggatcgcctgcgtataatcccagccagtcgtctttgtaaaccggttcatctgatcagtttttctgagcatcatgagaagcagagccagtgcgtggtctgccacttcattcattccgtaatccggtacatttccaacctgtatcccatactccgctgccgctttcagatccacagtatccacgccgaccccgtatctcaccacatatttaagctccggcagtgccttcataaccttttccgaaatattggcatactgaacgataaatatgtctgccccggcgcactgttcaatcacttcatcttctgttctggcacatgtgagtttaaattcaatccccgcatcagacaggactttcgtctcgatatcaatgttttcatgatcgcagtctgtaataatcaccttcataatcagtctcctcctatctcaccaaatatcccccatctaccgggatcactgcgccgttcagataatcggaacactccgatgccaaaaagacacacggtcccttcatatcttcgccggtcccccatctgtgggcaggaatcctgtccgtgatctctttgtttctcggattttcagggtccagaagcgccgtattcatctccgtagccatataacccggcgccagcgcattgacattgatccccttctcggcccactcattgcagaatgcctttgtgatctgtgccactgcccccttagatgccgcataggccggcactgtataccctccgaaaaaagaaagcatcgacgcaatattaataatctttccttttgtctgctggaccataaactgttttgctgccatctgacacagggaaaataccgccgtcagattcacatccagcacaaacttccagtctttcatgggaaattcttcgctcttatgccgcctctgtactcccgctccgttgacgataatatccaatgttcctccgagaagcttcaccgcttctgaaaatgcctgctccctctccttgtcatctgcaatgtctgcgatcacaaaactgcactgaaatcctctgtctgtcatctcttgagccgtcttttcagccccgggattaatatctataatacagacagatgcccctgcttccatcaatccctctgccataccgagacagagtcctcctgccgcgcccgtcacgatagcgcctttcccggtcaaatctaaatatcccatgttatctccttccgcacatatcaacatacaaaatatatcttttctacatgttttttacatccgaaaggtgcacagtgccgcgtttttcacagcaccttactcttaatttccgctgatcagctctgacacgatctgctttgtctcccagagtttctcctgtatccgtgtcaaattatcttcttttgtcctggtgaccggggctgaaatactgattccataattatagattcccctgtaatcccggacgctgacgccgacacagcacagtcccgcttcccgttcttcccagtcatacgcaaatccggtttctctcgcttcctccagctcttttaacagctggtccagactctgaatagtatggggtgtgaagatgacattttctccctgattccagatcttcctgacttcctcctcaggaagttccgcgaggattgcctttcccactgcggtgcttgacatctcaagctccagtcctatgtaagatcctgtggcaaaaatgtttgccgttggaagtaccttgtcgatataacggatcttatttcccgccctctggacaaaatgtactgtctctttacagtcctctgaaagctgcttcaaataagggtgcaccaaacgaactacattgtttctttcctgcacatagttgcccatcacaagcagacggtatgtgagaaaatatttttctgtttctttttcctgctttacatatccaagctctgctaaagtgttgatgatcctgtggaccaccgtcaccgtaagtcctgtctcatggtggatttcccgaatccccatggtctcattctttgccatcagctctatgatctgaaatgctctctccacagactgtactgtttctttcgccataataccctcctaattctcgactattacagctattataccacaatctgcagtttcattacacagatcacagatccccggtttctcctttgctgtcttcatccaaatgactcagatccttaaatttatcctttctggacagataaatcggaaggcccagcaaagtaagtcctacgcctatcagcgcattgaccggctgtgtaaagactgtaatgattactacaaacagtcctcccaggatagccagaataggaatcagcggataaagcggggttttataaggcctcttgaggtccggctcatccctccttaacttgatcacgccataaaatgctatcgtatagaagatccagataacaaacatacacatatcggtcagagagttataagaacctgaaatgatcataatagaggtcactgccagcaggaaaataccgcttacaaccggagttgcatacttcggatgcagataggcaaactgtttgctgaacggcagcttattctgcactcccatggcataggggattctcatacccatcataatattactgtttaaagtaccaaatactgcaatcaaaatacccactgtaatcagcttggcacccatattgcctcccatcagtttagctgcaacgtctgctgccggtgtagccgtatttgccagctggtctgccggtataacgagaaggtaaccaatgttgataactgcatatacgagtatgacaatactgagtcccagcacaatggcctttggaaggtcttttttcggattcttcatttcacctgccgcatttcccacatgaatccacccgtcataggcatacatacaagtcagcattccggtggcaaagatggcaataaacgagtctcctctctgaataaacggcgtcagattttccggactgctctgtgtggatgtaaaagccatcaggataatgacagccagaggcacaagttttgcaacagtaaatacatttccgatcatgcctcctacatttgcccccaggcagttgcagacgatcaggaaaaataccatgaagatggcgaacggaatcgtatatttatcactgaccccgataagtttcagcgcctgtatagaaaaaatggttcctaaagctcctacattggccggccagaaaacaacggattcacaccatccaagcagatagccgagtccctgtccgaaacatttttccacccaggataccagccctcccgtctttggaatggatgcggcaagctctgcggtagttagtcctccgaacagtgtgatcagccctgcgaacacccagatcagaagcccgatccccggtgctccgccggtaatcgtatagactgcctgcggtttgaaaaatactccggagccaatgaccatgccgatgaccgacagcataaccgtactaagtccaagacttctttttaactgtgtatttgattcatttttcattattcaatatcctcctttcccctttacaggctctctacaaacttctgtattctttccattccttttctgatcgtctccacggaagtcgcataggagatccttatataaccttctccctgctctccgaatgcagatccgggtgcaaccacgactccctgctgattcagcagccgctctgcaaactcctcagatccaaggcctgttttcttaatgttaatgaaagcatagaaggctcccttcggcggtctgcaggaaatcttttcgatattctcaatacattccaggagtgcctttcttctctctgcatactggtcatgcatctgctttatggattcctgcccattgctgatcgcctctaccgcaccgtactgggcaaatgtggtgacgcaggaaggtacattttcctgaagttttggcatcagactcacaatctccctcggtcctgccagatatccgatcctccatcctgtcatagcataggtctttgaacaggaatcaatgtaaattgttctgtttttcatgccgtccagagatgcgatattcacatattcaccctcatacagcagatgtttgtaaaccgcatcatagaccacatacaggtcgtgttccagagccactcttgcaatatcttccatgacttcccgtcctgccactgcccccgtaggattgcacggagaattgagcagtatggcttttgtcttgtctgtcactgcttttgaaagcccctcataggtaaaattaaaaccattctcttcgtacacgggaaccggaaccggcaccccgtgattcatgctgatctgcccataataatttgcatagcacgggtctgaaataagcacttcatcccccggatccaggagggtagccatgctcagatacagggcctccatgcctccggtacatacaaggatttcattttccggattataggccacatgatcatacttctttgtttctctggcaatagcctgtcttaaaggcagaattccggagttgtccgtgtaatgggtctgtccctcttccagtgctttttgtgccgcctttattacatttttaggtgtgtcaaagtccggttctccaagaacaaaactgatggtattttctttattctttgccaggtcaaacatccttctgatgcctgactgcggcaataaagttgcatctgataacttcttcattttctgaccccctgtcatcaaccttcatttttcatactgcagtctactaaaaccttcagtgtgctttgcttcggatcaccgatcaaatcaaatacagtatctgcatctttgagatccactatgtgtgtcaccactttttccaggtcactgcagatcatttctgcatatttgactgcctgcccgaattccctctttgtatagacacggcttcccaccaatgtctgctctttaaagtttacatcctgcagattgactgcatggggttctttatgtacgccggtcagacagatcctgcctccgatccggcatatctttgtcatctgtgccgccgcctgagcagaaccgctgcactcaaacactgtatcaacaccggctccatctgtctgttgttctatgtactcttccaggttctgatcttgtacattcaccgtttcaagtccgaactctttgcagatgttcagcctttgctgatctacgtcagaaataatgattctggaagctcccgcatgttttagtacaattccagtgagtactccgatcggtcctgccccgatgaccgccgctgtattcagcatttgaaaatctgcctggtgcatcgtccttatgatcactgccaaaggttcaatcactgctgccgccttatccgtaataccgtcatcaagcttaaacaatacattctcatcgcagcagacaaactccgcgattcctccgtccacatcgattccgatcagctttaaagtactgcacacatgagggatcccattggcacaggcaaagcattccccgcaggacaaaagcggatatggcgcaaccctgtccccctttttaaattttttgctgtcctctgcagtttcttctatgatgccgataaattcatgtcccagtacaagcggtgcctttgctctgggatgtttccccgaaaaaatcccgatatcagagccgcatataccacagtaatgcacctttatgcgcacctgtcccggctttagttcaggaaaaggtttctcctgaacttgcacctttccaggtccggcataaactaatgttttcatactgcctcctttcatttgttccgttatccggaacactattccttaattacaactacatcatagaagaatcatttcaggctgtcaatcattaagttcattttccacaatttaaccaagacattaaggaacaatagcttcatttcaatctaatatttggttaattcctctaattaacttttgtgcgtcatctctttttatagacgcaaaaaatatgacagaggttccaaaaaacctctgtcatctttatatttcccaaatagtattactctaaaatggcgcctgtgctgcctgatgtgacacttctggcataccttttcaagtatccgttttttaatttctgctgtcttggctgccatctgctttttctgtttttgatctcttcctcatctaccagaagctggattttatggtcagggatattgatttcaatcagatccccttcttccaccagggcgataggtcctcctacggccgcctccggtgaaacatgtccgatggccgctcctcttgtggcgcctgagaatctgccgtccgtgatcagtgccacgctgtctccaagaccgctgcccataatagcagaagtaggattcagcatttcacgcatacctggtccccctttggggccctcataccggatgaccactacatctccgggttcgatcctgccggcatagattgcttcaagggctgcttcctcaccgtcaaagactcttgctcttccactgtggcagagcatctcttctgccaccgcagaccgcttcaccacacatccttccggcgccagattgccttttaaaacagcaatccctccggtcctgctgtatgggtcctctgcaggccggatcaccgttttatccctgatttcttttcctttgatattctcagccactgtctttaaagtacaggtaagcagatccgtgcggatcagtcccagtttatccagctcatgcagaactgcaggaatgccgccggcttcgttcaggtcttcaacatagctctctccggccggcgccagatgacacagattcggtactttttccgaaatagcattcgccatggttaagtccattcggattccgcactcatgggcaatagcaggaagatggagcatgctgtttgtgctgcatcccaaagccatatccactgccagggcattttcaaatgccttctcagtcataagatccgatggcctgatccccttcttcaccagcttcataatctgcatgcccgctctctttgccagcctgattctttcagagtaaaccgccggtattgtaccgtttcccggaagccccatgcccagcacctcggtcagacagttcatgctgttggccgtaaacataccggaacaggaaccgcaggtgggacatgccttttgttcacacaccctgagttcctctgctgtgatctcacctgtctgatgtctgctcactgcttctgataccgtggaatagctgatcctctttttcttcatggttcctgccagcatcggcccgccgcttacaaagatggacggaatattaagccttgccgccgccattagaagtcccggcacatttttatcacagtttggtatcatcacaagtccgtcgaaaggatgagcctcggccatagcttccgtggaatcggcaatcagttctctggtcaccagagaatatttcattccctcatgtcccatggcaatgccgtcgcatacggcgatagccggaaatacaacaggcactcctcctgctaaagccaccccctgcttaactgcctcctcaattttatccaaatttcggtgtcccgggacaatttcattttttgagctgacaataccgatcagcggccgttccatttcttcttccgtgaaacccagagcatacagcagagaacgctgcggggctgctttatcaccttgttttatgcggtcacttctcatcataataacctcctcttaatttaagacatcatacctcttgtttgttgtattataattcatatgatgtctaatgtcaatatatacatagtatctattttagaaagaataaagtgggcaagcctacctcagcttcccaaccctacctctttgaggggcttgacaactttgcgtaccagatgcggtttgacgtagtcaaatgatttccttacgcatctgtgtacaacccgcggagcgttttttattactcaggaaacactttcacacattagcgtgacaaggtctttcctaagtaataaaaaaaagaaggcctgcgccttctcttgaactttatatttttaattctttcattgcatgtaggatatgaatcctcatagcgctcctggctccctccgcatttctggcttccagaaactccatgatcagctgatgatcctttaaggtatcctgtaccgccatctctttctgcctggacagcgtgactccctctccgattccctgatagatcacaggcatcagctgattcataaactcattgtgagtagccttagcaatggatctgtgaaacatctgctcttcatttgtccggtcttccttcttccggatcttttcttccacctgacgcccgaaagaaagaatccggtcaagttccttgtcactggctctcaaagccgcataataggccgcttccggctcgaagatcaatctcatctcatagagctccccagcattcaccttgacatctttcaaaggcgtgagcagcttcacatcatccgtgtcgatatcctgtttcacaaatgtcccccggcccctttgaatctccaaaataccattggcgaccaaggcccggaccgcttcccgaagtgtcgtcctgctgatctccatctcctgtgagagttcattttcattgggcagtttatcaccgggcagaaaccgtttttcaaccgtgatcatcgcaaggatctcctctgccgcactgtctgaaagccttttttctcccatatttttctccttttccgtctcaggcacattttatccacaattctatctcaggaatttttccgctgtcaacaccccggacaataccttccacacctgttcatatccctttctgctgagatgaacaccatctaccgtataagaaagcggcagttctccatcctccccgatcaattcccggtaaacatccacatatggtatttctttttccccgcaaagtctctcaatttctgaattaacagcctgtatctctttgtttgacttcccttctgaccagaaaggaattccatttcctgtttttttcgtatacattggatacagtgattcgatacaaatccttgtccccgggagtttctccaaaatccgctctgccgtcctcaacaactgaccggctaccacctctgcgccccggtaaaaaggaagcagataatcattggccccgccctgcattagaactaaatccggtttcagcgaaaccacatccatctctgccctggcagccatctccggcactgtattgcccgcctcacctctgttataaacctgcgcctccacatcttgaaacaattccataggaaagtagtcggtgagagagtcaccgaacaaaacgaggaccttttctttactcatcgattcctacgtattcatatactttatctatgaatacttctccatccaaatgatcgatctcatggcagaaacactttgccatctcacctaccaccgtataagatacttcatgtccgttttcatccagcgcttctaccttcactctggccggacgtatggttttaccgaaacggttcggaaaacttaaacacccttccacacactcctgtgatccgctgctctcaacgattacagggtttaccaactttaaataatatccctcatagtcgatgacgatcattctcctgagaatgcccgcctggttcgcggcaagagccgccccattatctgagctgtgcagagtgtccatcagatcgtcaagctgctgccttgccttgtcatccacctcaggcaccgtcttacactttttctttaatatcggatcatttccggtacggatctttctgacagccatttcatctcctccttcagttctctgtctttcttattcttcatactttttaatactctcaagaaacttctccccgtatttttcaagcttaaactgtcccactccgcttatattaagcatctcatccagagtctgcggtcttacctcactcatgcctgccagcgtcttatccgaaaataccatatacggcggtatcttctcctcctttgcgatctccatccgaagcttcctgagttcttcgaacagacccatatctttttcttccagggcagaagcagctccggccttctttttcctggctttcggcgcctgtttttcttctctcttcggaacttttatgacaagtttttcaccgctcaaaagctcttcggaccggtctgtcaattctattaccggatagtcatcattgctcaggtttaaaaatccctgcatcatcatctcattgatcagctgtttcagtctcggaactgtcatatccggcaatgccttatattccggattttcctccagtcctctctgacgaatcttttgattgtctgcccctctcaggacatccacgatcagattgactccaaaacttctctgacagccttcgatacatctgacaactgcctctgcctgctctgtcacatccaaaagatcaaattcttctaaacagttactgcagttccggcattccgcgctgctttcttctccaaaataatcaaggatataatgccgcagacagccgctggttgcacagtagaatgtcatctgtttcagccgccccagatccttttccatgacgatcctgcgggtctcctcgtccagttcctgattatcctcgccgtgttcaatcaaaaaacgattggtcctctggtcggcggcaccaaagtagaggatacattctgctggctctccgtctcgtcctgcccttccggcttcctgataatagctttccatattcttcggcatattataatgaatgacaaaacgcacatccggtttatcaatacccatgccgaacgcattggttgccaccatgatctgtctccggtcataaataaagtcatcctgattctcacgccgttctgtatccgacagtcccgcatggtatctggtcaccgaaaatcctgcttctctgagctgataacatacttcttccacactttttctggaaaggcagtacacaatgccgctgcttcccggcattttttcttctttctctcttaaataggattctaattcccggtatttatctctgggcttcttaactccaaagaacagatttgcccggtcaaatcctgttgtcacgaccagcgggtctctcagatttaggatatccaggacatcctcttttacctccacagtggccgtagccgtatacgcccctaaaaccggacgcctcggcagcttctccaaaaaggaaagaatctttaaatagctgggacggaaatcctgtccccactgagatacacagtgtgcttcatccacagccaaaaaagaaatatccacgccgggcgaaagagcaaaccgtaaaaatccctctgtctccagccgctccggagccacgtatatgatcttatacctgccttcccgtgccagatccagggcttttctatactgtcccatgctcaatgagctgttcagaaaagctgcatgtatcccggcctgattcaatgctcccacctgatccttcatcagagagatcaaaggggaaacaaccagcgtaatccccggcatcatcagcgcagggatctgaaagcagagcgatttcccggcacccgtgggcatgatacccaaaacgtcccgcccgtctaaaaccgcgtcgattaaaggcttctggccttcccggaagtcatcaaatccgaaatattgtttcagtaatccgcgtgcatcctccatatgtaacctttcattctgtagtagtttttaactccgtatactttaaattctttccttttactttatccacgggatacttttctccgtttttttcaattttagcaaggagagaatctttcaaatcaaattcatacatctgagaaaagcggagaaggaagaaaaacacatccgcaagttcttccgatatgcgttcccgtgctgtatcccgatccatcatctcccccatttgttcctctgatttgaaccggaacagatccagaagctcattggactcggttgacaacccgatggccagatcctttggcccgtgaaactgatcccagtctctgtcctcacaaaacttttgtacctcttttgttaaatattctaaagtgtccatataccttctccatcaacatctggttttcatgaatactgctattatataacaatttccccgggtgtggtatacccttctttaaattttagaaatattttacatttcttgctttaggaatgctccttacaggacatctcactcacttccagcttaaaagtacatactgcgtcaaacatttcctctgaaaactcccactcttctttcccggtgttttgatacataatagccaaaagcgcctttcttttttcattcgtatcttccacaaatgatacatttccgcttcctacaacactctgaaaccgggcggaatagccgcaggcttttgtactctcattcagcttataatttgtatccagttcaaaccctgcacagggatttttggagatcaattcaatttttctgccctcacctgcactatggaaataaaaagtcctcttctcgccatcctcacagtatccaaaacttaaaggcacgatatagacgctttctccatccgcaaatcccagcctgcagcagctgcacgccgaaataattgccctgatcttcgcaggatctgtgatttccctatcttttcttctcatgatccagtcccccgtaaaatacttattttaaaatccttctggacagttcctttactgaaagtccattttctttgatctgttttctccatcccatctggccagccagcttatacatgattctcggtatccccggagaaacaaaccggtcttcggctttccgcccggtgctgatactgcacgccatctctttcagcacagcggagaaatctttcttgattccttttccttccggtatatcagaaagcatggggatcattcctcccccgccgaggccaaggccctgtccccatgagagacctgctttcttacaccagcacttcataatgtttagggcaatatgattttgatatccttcgtaaaatccacagtttacaaccgcatagaccatcctgtcagtctcagattcctgaaagaatttttccatctgctgcagcacagccgtcagatgagaaggtacactgtccacatatagaggaaacgcaaatacaaggcactcgctgtccatgactgctgctttcattacttccgtcaattccggctttcggacagaaatttcttttatgttctgccctttcagcaaatctctgagttcctttaaaataaccccggaactgctccctgaaggcttaggacttccgttgatacatacaatcttcatgttaccttcctcctaactcatccggtgttttcacaaaccgtactccctgcacctgggcatacagattgaccgcattagctctaacaagctcctctgcagtccgcttctcatcttctgatatacattctccgtaaaatcccacttttaattttaatattttatcgtatctctgtttgtggtgcatttcgccattcttaatcttaaaatacggatgcagataagggatgctccggtccagcacatttttcacaaaaggactgtagcctccgtaacagcaccggctgatgatccgggcctcctcacaccgggcaagcagttctcccatatcaccatactggtctcttataatacatttgcccggagtcttgatccagcatccgaaacagccgatacaattaaggatttccccgctgtttcctatcaggactacatcttcgtccggttcagaaaatatatttttgaattcttcttcgtccagatcatgaatgattaatttcatatttccccctctcatagtataagttctgtctatttatacagcctcgaaaattccattacctgttttctcaacgcctccaatgcctcttcttccttgtccggttcctggtcatatcagttcagcaggaaaaaaatcggggcataaaaattaactgccatggcttttgggtctttcccatggaaaatgcccctggcggtcatttccgcaaacaattctgtctgataggacactgccgcatccataaaaagcccccggtacacttcaaacacctctctgtccctgtactgctcgatcacgagcatcctgcggaacttagacgcaaattcatctttcagataaaacaggaaaatcttttcactgagagcaagaatcccttcctcgctgatacttccataaagctctgcggcttctgccatatcgtgttcatcgggcagaccgtactccttggacatctgttccatccgaaccgacatctcctgaacaatcgtatcaaatatttctttcttgcttttgaaatgtttatataaggaactgtcttttatgcctaccgcatccgcaatgtttttcacactggtcccctgatacccatgtttagaaaatagcgtgagcgcttctttcacaatccgttcttttgtattcatcatctctctccctgtaataaatcttttaccagctgttcctgttcaaacagggcacagcctccggtatgaaatttctcaaggcttccgctttcctgcagtctcgaaaaaagtggagactgcagtgcctctttgaggcttgtatgtaccaaactggtatctgaatagggagaaaacggacagggctctgcgccgccggatgcattgatatggaaaaatcccctgcctgccgccagacatcctcccgaagccctttcatctcccggaaacgatataaacaccatatcctcctgttcctctctgagctttcggatccttttttccaacgcttctctctcttcttcccccggagctaaatactctgtctttccgtcagccggtacatattccacataaacgaccgccttacagccatttgttccaagttcaccgaggaattcttccgacgtgacctcgtaaagattttcccttgtcaccgtaaccgatgcgccaaataaaaggctccgtttttttaaacttcccatggcctgtctgagcctttgatagactccgcttcctctcctggcatccgtctgttccttgccgccttcaatgctcagcaccggaagcagattcctgttttccgaaaacaatgtaaggcagtcttcctgcattatagtcccattcgtaaacaccggaaagatcacctttttatgcctgcctgcagattctatcacatccctgcgcatcaaaggttcccctccggccagcaagatgaaacttatgcccagtttttctgcctgaccaaaaatatcatcccactgtgcaccggtgagttccccctcatgcagctcttcagcacaggctccgctggccctggcataacatcctttgcagtgaagattgcattgactcgtaatacttgcaattaaaaatggcggaatatgcccgccctcttcttctgcaatttctcttaatcttcgtgctcttttttccgccgccataaatttcagcataaaaaagcttccccttggatctgaaactctcaaaataccgcggaggatacgttcaaccccgtcacttaaatacttctccagccgaaaatcctgcatactcttgccctcctttgacacgccatatatggctagtaattgctagcttctgtcatcttcagtatagggtagtgaacactagcctgtcaagtatttatacgccgaatctatatttctttccaataatcagacattttgaatctgtcccatgaccgatttcctccgtctttgcaatgggaattcccggaccagccgtattcttcaccaactcctccatccttggaagacatcctccggcttccattgctgtaaatgttccgagtaaaattccattgacctgctcaaagactccaatctgttttaactggtttaaatacgtgaccatctgaggaacctcccctcctctgctctccaggaataagatcttatcctgcatatccggccagaacggggttcctgccagcttcagcagacagcggatatttcctcccaccaccatgccttccattgatgttcctctgatcagcctggtcctgaactgaaacaggccgttaccgtttccaagcagtgaatctttaaaattctttttctgctcttctgagtgatccatgaccagattccggacttggtacaaataagatttccggcctgtctgctgaaagactgcgtttacgattacagtgagatcgctgtatccgaaaaatggttttagatgttctcttatgacttgaaagtctaaattcgtcagaacttcattggccagatctcctcccgaaatatcgaagaccgccctgattccgggattccggtaaaactccataagttcccctgcgcgctgcctcccggttctgtcaaaaactgaggaaccggcataaagataccggctgaagactggttttaatcccagctccttcagggcattttccagcggcatcacagcgggccgggccgagtctgaaagtccgttggaacagcatactattccaaccttatcctgtctcctaagcatcattgccctttccctctcttaacaattccaacccgtttcatatcctcttccaataatgcgcacggatgatcatatgtctcaaaaccggccggcgaacaaatatctcggttcacccaatgacaaatatcctcctgatacatctctcccagattccagggctcatctgtataatccaggcgttctattgccttattaagccctgccacaggcttccgcccgtgagtctttgtgatctttagcgctccggccagattaaagtaagcattgatctgctcctctttatatccctcactgcgcagaccggcctctatggcttcttctgccctttcgggcagcactttccagtccgctgctttcattcccgcgagcatcacaaagaaccgattgtttgcattgaccatagccaatgctctttttcccataaaacgtataacatgcagttcccagcaaaaaaacaagtcggtgggctgcccatacggcggctgttttaccttcagatgcttttgtaacgtaatcgtaatccccagctgcatttgttctcctcctcgcttttggcttattctaaatctcttatctttttcagctcctcctcagacatagagtccagcaaataactgcggtccttttgctgcttttctaaatatttttctctgagtgtttgattggcgagattcacttcttccagcagttccctggctgagagcagagaacacccctggccccggataatgatctgttccatgccgtcagaggtggccaccgtaacatcatatttccgtccatgttcgtgcgcaaacttctctatatattgatctgcagtctccgcttccttcgtatataccacatggatattatgataatcgagtatctccgtatcatggcccacaacgcggtaggcatcaaaaacaacgatcagctgacattttctgattccttgatagttgctcataatatccaaaagttttcctctggcagcgtcgatatttgcctctgccagttctcttaaatcctcccaggcaaagataatattatagccgtccaccagcagatatttttcacccggctttttcttcactgaagccctgaaagccgaactcttataatcatctattgtcctctccagtttctttttggcccatccggtctttttctttcggttcgcaaaataagtctgttccagaatccggtcgatctcctccgtatcaatccattcttcttcggtataagaacggcgcaccgcattctcttcctctgtctctttttcattatctgtaagctggctgtccacatgcatataatccttgaccttgtcccagctcactgtaaatcctgccccgtgtgagcagaagacagaacccgtcggattatctgtatcccgttcagaatcatagccggtattttcgatcacttcgtctgcattgtgacagggcctgtaaccgttaagggcacaaaaaagacggccccttcccttcgcgtaagctatgacttctctctggtagccgttcatctctgagaccggagcacttccggtcagaactgacatctctccctctgtctgaggattctcaaactctccgtacatccgctcaatatccgacatagcccgtcccaccatctgctgaggcacttccaggcgaaactcatagtacggctctaaaaggaccgactccgcctgtttcaggccctggcgcaccgcccggtaagtagcctgccggaaatcaccgccctcggtatgttttaaatgtgcccggcccgccgctaacgtgatcttcatatcagttatcgccgaaccggtgaggactccggaatgctcccgttcctgaagatgagtcaggatcagcctctgccaatttttatccagcatgtcctcactgcactgagtatcaaactgaagaccgcttcccggctccaacggctccatgaaaagatgtacttccgcatagtgcctcaaaggttcaaaatgcccaacaccctccactgtatttttaatagtctccttgtagacaatatttccagtcccgaattcaacttctgtatcaaaccgttctgcaatcaggcttttcagtatttccagctgcacttcccccatgatctgcacctggatctcctgaagctgctcattccaaacaatatgaagttcaggttcttcctcctgaagctgcctcaattttgggagcattactccagcactcactccttccggcagtatgacctgataagtaagcaccggttccagcgccggctcatacccggtatcctcgataccaaacccatctcccggacgggtatccgcaagccctgtgaccgcacagatcattcctgcctgtgcttcctccgccgtctgatatttttctccggaataaatcctgatctgactgaccttttcctctttgggtttttgtatcagcgccgatcttactttcagcacacctcctgtgacttttaaatgagtcaggcggctgccctgctcatccctggagattttaaacacctttgctccgaattcttcgggataatccacaggccgggtataagacccaattccctgcagaaattcccggactccgtctgctttcaatgcagacccgaaatagcagggaaatacccttctctctgcaatgatctctgcaatatccctgctgccaatccttccgctgtctaagtatgtgttgagcagtccttcgtcgcaaactgcgatatcttcataaaaatcctcaccgcactccctgctgaaatcaacacagccctcatcgagccgattttttaattctgtcaaaatccattgtttgtcagtacccggctgatccatcttattgataaataaaaaggtcggaattttgtatttctccaacaggctccacagcgtttgcgtgtgaccctgcaccccgtcggcaccgctgatcacaaggaccgcataatcaagaacctgcagagtccgttccatctcggcagaaaaatccacatgacccggtgtatccaggagtgtaatttccatttctccgaaccggaacactgcctgctttgaaaatatagtaatcccccggttcctctcaatctcatgggtatccaaaaacgcatctttattatcaactcttcccatgctccggatgctgccgctctcatagagcagaccttccgacaaggttgtctttcccgcatccacatgggctaaaattcctatacaagtatatctctttggtttgctttcagatgtagcttccattataattcctcgtcctttttctccttctgctataaaaatttattgctttctgactctctgtttccgctctcaactcttcatcatgtgggcaaatacaatttatatttcgctgcaaataattgctcattgccatgtaaagatatcttttgatctaaaatattataacaaataccctttaaacaatataggtattactttatctaatacatgaaaaaacagccccagatcaaaaacctgagactgtccgtattactttttttgataaacagaatgtcctaaaaactcccacttcccgtgccccggccgaataatttctccgttcccgagaaataaatatcctcccggttttaaagactgataaagaccctgcaaaatctcttttttcttttggatatccatatacacaatcacattccggcagaaaatcacatcatactgctcatccggccactgaagctctgccaggttgtgatagcggaaccgcaccatatccttaatcagctgagtcactgcataaacagttccatccttcttaaaatatctcatcttccagtccaccggaacttttataagctgccggggcaggtactttccttcctctccctgtgtgagttcgtgttttgcgatgtctgtcccggtaatctcaattttgggaagtttccacccccgtctgcggcattcctccgctgtaatggcaatcgtgtagcattcctcaccagtggcacatcctgcgctccatatgcgaaatacgttttctctatctcttaatctctgtaatatttcatgctcaagatactcaaactgcccgctttctctcataaaatatgtataattcgtggctgtaagatcaattaaattctgttctgtctccggatctttctttactgtctttacatactccaaaaaactctccagatgcagccgttccagctcatgctgaatcctgcactgaattaaatttcttttgttggaaagcttcatcccatatcttttctgaatgtattctgtcagggcatcaaactcatcttgattcatctcaatcattttctttactcctaggttttacagagatcatctatttttcagtgaaatacgctctgcgcgataagctctacccacagggcacaccgtattttatgcccttggggcttggcgcgcttcgcacgataaggtttactttacaactgtttcagactcttttcaagatattctttcagatatagacataatttcaccaaatttatgaagtaagacattctttcaatgctcttccgtaaatatttgtttctttcatgcactgaataaaacttgcttttgtcactccgcttttctttggacgaaactcccattctgtcgttgtaagagccttatctgccattgcataaaattcgttctcacacacttctatatcatcaaaacaaaccggaagccccatactcagattgaattttgcgattttatcacgttcttcaaactctttcgcaaatgtgagcagacacagtactcctaaggccactacttccccatgaagatgacggtgccctccctccgtaaccgttgatccataatatacacaatgtgccagacttgaattatagtagtaatcaggcgcactgctgaccatattggaaacaagtcctgtactgatgataatatccagcgtcacctgttccagttcataggaaactcttttcttccttaaatcttccagcgctttttttccatagtctatcagcggagctgtacaaatacggctcagctggactcccatcataggcgtatgagataactcatcttcccgggacgcaaacacggcctcacattccttgctcagggcatctccgatccctgcccagaggagctgtcccggagaatcggctataattgatgattcaatgaatgtatggtccgctgctttgggatagtagtattcgcgaaaagaaccatccggatgataaatcactgaaatcgcagtcactgccgcacagttggatgcaactgtaggaaaacaaaacagcggtttgtccagctcattggccagatatttacctgtatcacaggcacgtcctcctccaacggcaaaaatcatatctgcctgcttcaccacatcctgctccatcagagcattcccgttttcgtatgtagaatctcctccgtaccagataaagtccaaaatctgcacgtcagaatccttcaccccctccaaaagcttctcttttgcttttgacattgccgtctttcctccgatgacaactgctgtctttccaagaaaacgagccttctccggaatttcccgataacagccttctccaatggtatacctgggtagatttacactgtagtaactcatatattgtccttcctttctcattttatgcagcctcacagaatattcatttattccgccgaggaatttctttgctttcataacggactaaaaagtctccttatgtcgataaacataaagagaccaaatcatccgctattcattttcggactgctgctgatacattgaagtcattataatcctcaaaaaaataatatgcaagtaccttttacacctgtcaaattttcctagatttatatagacggatagtatcttcgattgcgtgataatcccgctcaaacagctcatcactgatttgggtctttaatacagcctgaggaaccctctctataattttatcaataacaaatgccttgctcttctgtttgtatttaggaagctgatttaattgctgtatatgagccagttccggcctccatagcaatttcattttatctctccacacgagtttcggatttttgaccggactccggagcagatagaaatccacctgatcacctatctcttctgccgtaatgattccccaccattccgggaccttttcctctatatgcagtgcatgtctggtgcctgctaccacatagttatagtcgaaaaaccggtcataatctttgacctgtctgttcagccgtgtataactgtccgcatcgctcttaatctctataccaaaaacagaatcttctgtaaccatgacaatatcagccctggagcgtcccatctgtttttcttctataatcctaattttatggtagcgctcctccagaaaatcaaacagaggatcgcgtatgtctttatcgtacagcataaattccttttcgtttttatgatttagaaacctttatacttcgttcttcttcctctgccttcaaactatcgtttattttattctctattgccaaacaatcgcttcttttttatccattacaacatccttggtttttcttttatcagctccagattaatattttcagctactgataagtgacggttcagcagcttctcaagctctgctccatcctgcttttccagagcatccatgatcccctgatgttccctgattgtctcctgcatccttccttcccgtgtaaaagaaagaacattctgccaaaagatacggtgcatatattctttatataaatgaagcattgcatcatttcccagaaattctacaatacctttatgaaactcataatcgatcctcgcaaattcctcgctggaaccatttgtttcgatcagattctgctgcagtttaatctttgtccgcagatcaatcaaacatttttgtgcattagctgaatccaaatctgcaaccagctgctttaaacaaaaggtttcgatagcattccgtatttgataggtctccctgatatcatcctccatcatttcatgaatcataaagcctttgcttggatagacatcaatatatcgttcctgctccagccgtaaaacagcatctctcaaaggtgtttttgaaattcccagttcttccgccacttttttctgggaatagatgaccccatgctccaacttatcgttcagtatcagatctttcagataatcatatgctttggactgcaacagctgtgtacttttcatactactacctcatcttctataaaaagcctcttcatattgttaacaattacctaatactatagcatatctttcagaatctttcatccaccgcagattattatggaacaaaaaaacatccttttttctaatctctctgaaaaaaggatgtctgctgaaatcttaaattgctaaaaaatcactttatacaacattgccgcaagaaatgctcccatcaaaggacctgctatgggaacccatgcatatccccaatttgatccttctttattttttatagggacaagtgtatagataatacggggcataagatctcttgccgggttaatggcataaccggtcagtcccccaaaagacatgacccctcctgccactccgcagaatacaaagaacattgccactccatttgccggattttgatgtccaagggaaagcaggacaaacatgagacaaaaggttgccatgatctctgacagacaattccgccaggaattctgaattgacggacctgtggtaaatacacccagcttggtacccggacactcttcttcatccaaatgatctttatacagctgccagatgatcaaagctccgacagatgccccgatgcattgtgagatgatgtatcccggaacaaggcttccgctcaaatttcctgctgcccaaaaacctaccgtcaccgccggattacagtgagctccggatacaggtccaaaacacactgctaccgtcaccattgaaacaccccatccaagagccgctacaatacctccggccccgcacataccggatttactcaaagaaatattggcacagacccccaatcctaacaccataaataatgcagttccaaccagttctgcaagatacagattcatatgttccatctgccactccttcctgaaccgccgttttatcagcggatcaattcctcaacagcctctttcagtgtagaagtctctcctacattacccggaaagataatatatgggattttcggaaatttactttgttcgtctgtctgccagacaggaattcccggtttgatctggcccataacatttgcttttttcactgaaagtgctttcgtcccaatatcactggatgtaatgcccccctttgcaaccacgaaggcaggaacaattttcagtcttcccaccagagcctgtaccccctgtgatatctttacagaccggagcagcgcttccattttgctgtcattgtcaaccgtcagcagcctgcgttttgtataacatacagcagtctttccggatgctatgatctgttcactaagactgaccacccggctgatctcgccgtcaaaaatctgatctcccttcagcaccagatctgagtcaaattcaatccctgttacctcgtctagtgtcaggagttcttttaactgcgctgtcgtcttattggtatgagaacccactactacaattcccccatggtttgtatctttagttatcatctcttctctggtcaaaagcttccggtctgatacccctccgatcacttttaccagggatgctgccgaacggaataaaaatgtcttcccttttcccatagcccggtaaagcgcagtacaaaatactttaagatcacagtaatccactgcattgacaatcaccttattgaaatctctaacagtcatcagcttttgctcgatttgtgcatagttacagtttctgagcatttcaagagaaatgcagacggtatctttacccttaaacaacccttgatttttttcttctacatactctctcagatctgagctcttgtatccgaacgttttatctttggcaaattccgtctctccggccggcaccagcatttcattatctattacataatggacattatcaatggtatatcttccgccttctttgaaaaagaaacacaaaatctccccgtccacagaatgaccgccctgcttttccatgacttcctttaaaacatttgtctctaaaggataattccctcttaacgtggaatcactcctgctgatcaacacgtatttctgatttaattcccgggagatttcttctgctgttcgggcaatttcttcatgcacctgtcttgtctgttccggtgtcatcgacctggaattggttaatatgtaaaatagtctgttttcatcaataaaaccttttctcatactggcttttgaccagtctgtaaataccgaaatatcatgaacagtctgtattccggtagggtcatcatccaaaacaacaaactttgtctgacttttattaatttcttcgttcaacagacgatcgattaccccttcatttacaggactgtactgctttagaacttctgtcttcctatattcagccatgattcatcacctctcagtattctttcgttgtactttttactactgtctgtgcaagtttctcaaaatactgcacgatccccgcatgatcgtcgttcatatgtcccgctaccttcagagcctgaaaaatctcaaaaagctgactggtaaaaggcaccggcacgtcaatttcatgggctgtctcaactacattcttaatatccttgtgattgatagagatcttccctcccgggttaaaatttctttcaaggatcatcggcatttttgcatctaagacagcacttccggccagtccgcctctgatagcctcatacactttggatggatctgccccagcctttgatgcaagtacaaaagcttctgaaacggcagcaatattcatatttacgatcacctgattggcaagctttgtaatgctgccgctgccgcttcctccaatcagaagtgccgaagatcccatgatctcaaaatatggaatcagtctgtcaaaagcgtcctgttcgcctcccgccataatggcaagtgttcctgaaacagcccctggctccccgccgctgacaggagcatccacaaaactgacccccatcttttccaatctgttatagcattctttcgactgtacaggagtcacagaactcatatcacatatgaccgtcccttttttgaccgcagatgcaatcccgtctttcccgaaaacagcatccttcacaatcataccatttggaaggatcataaaaataatgctgcattcctttccaatctgcgcctttgttccttctaaagctccaagatctgtcatctgttttactgactgatgattcagatcattcaccatcagttctatccctgcattctttaaattaatggccattgggagtcccatgatcccaagacctataaatcctacttttgtcatttttatgtctcctgtcatttctcttcaatttccgctatgcatacaacctggctggaatccagtccttcaattctcagtggcgcattgataaaattcagtattttcgcaccttttggaatttctgaaagatgcatgtcttcaatccctgtcacaaatttccctgtatagaatcccaaaatatttctgtgacaatccggaggaagttctccttccggcactttgtcagacggcgatccaatagcaagaaaatccattccgattccctttaaatccggaaaattttcggagaggtaaatacccgcactcggtgcaatatacggtccttccttttggtatctctccggctctgtaaacttatactgttcaaatcctgtacggatcagggcaaaagatacctgtgataaaacatccgcaaaaggttctatatcctctttggtgattccctgggcatcgctctttggtatttctaaaagtgcggtttccttgtgaaagaaatattctatcggcagttcattgatactgatcccgtttttaacaaagtgtcgtggagcatccatgtgagttccaaagtgattgggcaaagtactgataaaggaacaaaacggacaatcctctgatacatccgtcatctgctccaccttaataaccggctctcccggccatgcgaatccttcagggtctaatttgtgtgataaaaataaatacattgcagctacctccttctctctaaaaacctaaaatgaacctatacttttgatacgattagtataccggtatatcggtatatcagtcaatggtttcttgacattttgtataatttatatattattatcaatcatttattgtgcataattataatagtttttctttttattaacaaaaagaagtctctctacgttaaaaaacataaagagacttctgatgtaaatttctttctaaggttatcttaaaactttaatctgaactcaataacttattaattccctgagcagtctgcttccaaagcaaaactgaaatcatcctaatttctttcccaacagctcataatagaaaatatactgctgcatcacaccctcacaccctctgtatctctctgccggaaacccgtcaggataatggccttccagagcctgtctgatatgggtgtccaccggaaatgcctcaaaatgatgcagcgcaaacaggcagatacaatctgccactttctccccgatgccatacagtttcattaattcggcctttgcctctttataaggcatctgttttattgcctccaaagatacctctcctccggtcagactctttgccgtccgcactacatacttgctccggtaccccaggttgcagtcctttaaagcatcctcatgaagttccgccaatatttctgctttgggaaatgtatagtaaaaattcccgcacccgtcagatcttttctcaccataacgctcacaaatgttgtcaatgcaccggcggatacggacaatattattttgctgtgaaattagaaatgagacgatcatttcccacaaatcctgcctcaaaatacggatgccaaaaccaaattccgaggcttttttaaggtaactgtcttcttcgtctatggattctatgtattttttgtaatctgcattcagatcaaaatactttttccaaaatgtctcatacttattttcatcacagtgaaatgtgcattggcctccattctgggtcacttctaaatattcatttcccgcaattaccgaatatagattgtcacgcttctgcctcatgcggaaacactgaccggaatcgcagatctgtgcaatgttaaaacagtctaattcttttgttatcatagtactccttatactgtagatatataaactttctttttatacttcaacattttctctttgcctcatacgaaattatctaacttacatctcttgtatttcagcagcttcaatcacttatagttatttctaatacgtatacccaaagcggtgggatgacttggatgcaggatttcaatcacttatagttatctctaatacactaagcctgacacttgaacgatcggggacaccgggatttcaatcgcctatagctatttctaatacccatttcttccgcataaaatagtcattcttttaaaacaacaattcttaccaaaaagttcatatatctctacatcccgtataaactcgtattttttaaaacggtcgatcccccatactttttacgctatcataggtcgacctttattaaatatcatactataacaactgcctttttcccatatattttaagaatttataaaaaatactggtacaatcctctaaatgttttaatagcctcagaaacgaattctgaagctattaggagaaaaaactgcagtatttaattcatcacattttatacacaaattttttcacaattcagtctctatcgattatctcatccacccgatccaacaccgcctcataatcaaccttctcataatccgtcacgtccagttcaatcaggctccccagctgaaacctatcataacctttatttaaacacctgtctttaaatatttcataagtcaccagagcatccgccttcgtccggtcttccagtacgtccccttcatgatatcgtgtcaccagatgtgccaggtgtctggacggttccaggtctctgctttttgaacgctcatacagaacatcaatgtctccggtaaggcgaatcgtgagcacttgatatccataagtcaaagacagactttcaagccttcccttctgtttctcgctgaacggataatccgaaattaccgagtgctccccgctcatgagttcctccagcgtttcatagtacaactcccagctttgatcttccagacgagtcttttcttcgatattttcaaatccaaaacggtcccacagcttctctttcatttcatcctgagaaactacaataaattcactgtgccgcttcaaaatacggctgcacagaaatgtcttccctgtcgccggataaccggcaaggagtatcattgcttttttcatacatctctcccaaagaaacagactgccgcggcaaagcggcagtctcctattataatgctaattcaactgtcagataataagtatctgcccggtaataagcttctacatactctcttggaattttattttcatcataggaaacacgtttcacatagatcagcggggctccctcttccacctgaagcagcctggccctccgctcatctgccagaatagaataaatcttttcttccgcttttgccagcttgatatggcaatggttcacataatacactctcagcgattccttggaaaagtctttctccagggcctccggaacccactgataatccagatagttggtctcaatatacatgggcttttcatctgcataccggaccctctcaatcctgatcacttttgccccttcttcaagctgaagattttccaaaacttcctgatccgcactgatgaccgtcttgtccagaacctttttgctcgccactctcttgccgtcgctgtgttcccgtaaaaaattgacgatcttctggttatcgctttttgccttcaagttctttacataagtcccatggccgcgttttttttcgatcagcccttcatctgccagcatatccatcgcctttctgaccgtagccctgctgaccttgtaatatgccatcatttcactctccgcagggatcagatccccgatctgatactttccggtgacaatgtcctggtacatataatcatatatctggtaataaagctgttcccttccgctgaaatccaattcgtgtttcatcgcttacacctctctgtaactatattcctaaaattattccatcagctccccgcccacaagattgatggactgtccggtcagataacttgaactgtccgtagataagaagatcgccgcatccgttacatttttcagatctaccagcttatgcatcggaatattcttctcaaaatacgggagcacttcttccggatctaaatttcttttctttgcatattcatattttaacttctgccacatctctgtcgggacgattcccggacagatggtatttacccgtatgcccttgtccgcaaactcttttgcgatagactgggataatccctgaactccgtatttgcttgcgcagtaaatggtctgccaggaacttggctttttccctgaaagtgaagacatattgatgatcgttccgcctccgtcaagcatctgcctcactgccgcctgacagcataaaaaggtagctttcagattcacattgattgtcgtatcccaaagttcctcgctgctttccagaaacggcgccattttggaaaatccggcagagttaatccatgaattgattctaccatatctttcggctgctttacatgtgttttcatcaatttgctctttcttcgttacatccgtcttaaaaaagcaggcctcaccgccaccggcctttatttcatccacaacctgcatggatttttcttcattcaagtcaaagatcacaactttggctcctctctttgcaaactcttttgccatagcggctcccataccgcttccgcctccggtgatgacggttaccttgtcatctaatctctccacattcattttaaaagcctcctttactttttgatatactccgcaacattgacctgtttatcctgaggcatcacctggacaaaaacattgactcccttttggattaaatcaaggaagtttttattttcttccgggttggtggaaatgtttttatacaaaacacttctcccctcttttgcacccattcctcccacgtcaatctcatcgatttcaattccgtgatccaccatgtaatttaaaatctccggtcctttcacaagaaggatggtcggagcctccagcccctgtttcataaattccaccgcgtcatccctgttaaagattccgatggcaatctcatcgggcactgccatttccagcacattgatcataaattcatcttctgccacttcatcatcagccacgacaacctgcactgcatttttctgcttgatccatgccgtcatcacctgcccgtggatcagccggtcgtcaattcttgttaagactaagttttccatgcttcctgcctccttcgcttaaattcattccctttactgccaatgctcccggagagaccgcttcctgtatcagctcatccagtgtgctcttttccgtcctcgcgaaaatcagagtgatcagcatcggcatactcatacctgaaaccagaccgatcttatggtctttcgccaggtatcctgtactgttaaaaggggttccccctgtcacatccgtaagaaccaaagtgccttcctctgattcgtattcttttatctcactttccagtctgtttctgtatgcttccggcgactctccgggcatgagaggggcagctgatatcccctcctgttctcctgccaccatttggaggctttctaagagaccttcacagaaacgcccgtggcttactaatataatatgtatcataacagcacccctctatcctacaaatcccagcactcccagataggatgccgcaattcctacaatgaagatgcctataacgatccatgtgacattgatcttctttgaaacaagcttccatacgatcagggtaatagccaaaggaatcagtcccggaagaagggaatttaagatctcctgaaacttcacgacaccactgcccacggcaattttaaacggtgtattcaccgtaatccttgtggaagccatgcatcccacaaccataaggcccacaatgctgaacgcattggtcaccttatcgatcacaccgtttttaagaattttcagcagagtagattttccgtatttatagccgttcatgaacatgaaatatccgcatgtaaaaatcaggatctcaaacaataccgtaaagaataccggtccgacgaaattccggtccagagccatggtacagccgatacctgctaaaatcggaaacaggattccctgcataacggtgtctccgataccggctaccggccccatcagtccggtgcggacagaattgatgtcctctgcagatacgctttctccgttggctctggcctcttccatagaaaccgtgatcccgttaatgatcggcccgatggtaaagacttctgagttataaaataccatatactttttaagctctctgacccgttcttcattggattcgtagagacgtctgatcggcccaatcatcaggttggcgattcctagtgcctgcagccgttcatagttgtagcatgcctctgtgctggtagtggcaagccatgtctttacaagatctctttttgacagttttttctcataatctcttgcctgcgtttcgtctgtatagtctgtgcgctcttcatttttcttcagagtcaggcgcttcactttcttcgttttttcttcctttttattatcagccataaacatgataattgcaatgattgccgcgaaaatcgcaacggccataatatccagttttaagtagatcgtcaggaaaaatccggcgaagaaatacggaatcagctttttctttccaagatagtttaaaagcatggcgattccaagggcgggcatgatccctccgacgacctggagcgcagatacaagactcttcggaatcgcattgatcagggccgtgccccaggacttcccggacatcacgagggcaaaggcgggaatcccatacagagcaaaggccaccaggaaagacgggacaaagttcatgagcctcacccctctgatatttcccttctcaagcattccatcagccctgtggatccagaaagagtttacggtcatataaacctggttcagtaagagtccgaacatactgaacggaatggcaaatgtcaccgccatggtcgggcttgcgcctgaaagaatcgtcatcgccgtgccgaagatccccgctacgatcgtattgctcggcatggttccccctgcggaaatccatccaagatagattaactgaatgttggctcccgccagcatacctgtcatcgggtctcccataaaaataccggtcagcagacctgtggtcagcggatacaccagacattttgtcaccggaccgaaaaaccaccactggcccatcgttgccaacaaagctactaaaatcgctgaaattaccatcttaaatcctcctcttttcgattagtgttttccggttaaacggaccatcacttttcctttctttgcatacttctgtgtcttaagctcctcgcccatctcttccaggtcaagactggcactgatgatcgcatcggtatcaagctttctgctctctaaaagcgccaccgcccgtttcgttgtatttggatttaaataagaagtatagatgctgagttcctttgtatacgcctcaaattggttcatggaaaccggctcatccggatctccgagcccaaacagcagtaccctggcgttttttcccgcaatctttagagactgctccatggtcgcttttaatccgatacattcgataacatagtcaatattaaatgtctcagccagcttttctatctctttgtcgtccactgcataatcggctcccagctcaagagccagcttctgtttctctttctccctctcaaccacgataatgacagaggcccctgagagtttcaccatctgaagcatcaggcttccgatagaacccagaccgtaaattaccactgccgagccgcttcggatctgaatcagatccagtccgtggatcacacaggacaaaggctctgcgaatgccgcatttttaagatccagtttctccgacactttatagacgttctgctccggagggtaaacatagtcagaaaatccttttgccacaccgtgcctttcaagacagaaattcggaagcccctgctggcagtagctacatttcccgcatccgtaactgggatctgccgcgacccggtctccgggcttaaaatacttaaccttcggacccacagccgtcacgatcccggaacactcatgtccgaggatgatcggcggaatcaccggactggcaccgtttttcccctcaaacttgtgaatgtctgtgccgcacagtccgcaccatgccacttcgatttttacttcatcatcttccggttcccggtcaggtatttctctcacttcataggtccggtcccctgtataatatcctgctctcatctgcatcacccgccttaattgagatttttaaaaagttctattttcctctgtactacctggttgactgcttctatacacggcattacattatttctaagagaactgctctctgatgtctgtccaaaaagctctttggactttttcgtccaggtgaccagaagttctgtacccacattaaacttccgaattccaagatcgatcacttgtctcacatcttcatcctttactccggtcccgccgtgaataaccagaggaaggtctaccgcctctttaatctctttcagtctttcaaaattaatgtttgtcttggacttatactgtccgtgattggtgccgatcgccactgccagcgcgtcaatccctgtcttcttcacaaagtccactgcctcttttgggtctgtatagcgtacttctgcctctgatacggctactccgtcctctgttcccccgacgatccccaattctgcttccacagagacatcaaactttctggcatattcaatgatctgctgtgtctttaaaatattttctttcagcggcagggatgatccgtcaaacatgacagaactgtaaccggcatcgatcgcctctttgatctcatcatactcttttgcatggtccagatgaagcaccacatcgattcctgcttcctctgacatggtcctacacacagataccagatttttatgtcccacatatttagcagttccgacactcgtctgaatgatcaccggtgttccctgttcttttgctgccaggataatcgctggaagcatttccagactgtgggtattaaacgcccccactgccatgttcagttcatctgcttttttcaaaaccttttttaaatttgtatacatcttaacctcctcaaatattaactgctgccttttgttttaaaattctattacttcacctcccatcattttatcctaacgttataatgtacggacgtttgtacttttgaatgtattatacaactcttttttcgatttgtaaacaatttttaagccagaagatgaaaaaatcttctggcttaaggtcattctcatattctgttgtttatttaacagtactctctcccgcccaaatcctgcattgtgcaatcttcggttccgggtcaaatccttcttctactcccatggtagacagcatctcacacggaaaatccggacagactccacagtggtccaatccttttgcctcacagcaggacttcactccgcactcaccgccccaaaacggctgtttcatttctgtgcatcccgtacagtggacctcctcttttcgctcacatgaattgcagcagacaccgcatcttgattcaaacataattatcctcctaaaaattttatcctgcagttacatagtttcttttaattcctcaatccacgtttccagtgcctgtgccaagataagctgctgctctaagacagccattcctgttttcggaatctccggcagatgttctttcaggcttatattttcttcgatatatccttttaaagtctccatgttgttttcgatctctgtcaaacaggacttctgtttttccttcggcagactgtccagatttacaatgacggcattaaagtccagaaatatccggaccggctttgaggcaatctccagcataagcttttcaaattgcttctctcctgcctctgtcaaagaataaaccgttttctccgccatatttccttcttttacaacatcccctttcatatagcccttcttttccagctgaataacctttttgtaaatggaaggcgtactgatttttacccatttggatatattgcggtactctacgatcttttgaatatcgtatgcactcaaagactcctttttcaaaattcccagcacgataagatcaatagttgccatgatttcccccttttcgcttgacaaccactataatttatagtagtatgtgcttcgccgataaaatcactataatttatagtaatatattttatattttatgtcaaccgaaaggagagttcattatgagtgaacaaaacaaaaagatagaactgttaggaagtgctccgataccaaaagcgcttttagccatggggctgccgactatgatcggaatgatgatcaatgccttatacaacctggtagacgcatactttgtgggagggctggggaccagccaaatgggtgcgatttctgtggcatttcctctgggacagattgtggtaggtttaggtctgttattcggaaatggggcagcatcctatatttcaaggcttctgggaagaggggaaaaagaaacagcaaataaagtcgccagcactgccctttacagcagtatatttgtgggagctataatcataattttttccattatttttctgactccaatccttaagatgttaggtgcaacagaaagcattcttccctatgcagcaacctacacaagcatttatatcatttcatcaatcttcaacatctttaatgtaacaatgaataatattgtcacaagtgaaggagccgctaagacaacgatgtgtgccttgctgacaggtgctgtactgaatatagtgttagatccaatttttatctatgttctaaatctgggtgtcgccggtgctgcgatcgctacggccatctcacagatgatttctactgctgtgtatttatgttatgtattcagaaagaaaagtgtatttaatttcaaaataaaagactgctgtttctctaaaaagattatgtcagaaattatgaaaatagggatacccacactggtctttcagctgctgaccagcctttccattgcattaatcaacaaacagacaaaagtatatggagactctgttattgctgctatgggcgtggtcacaagagttatttctatgggaagtctcatggtcttcggatttatcaaaggctttcagccgattgcaggattcagctatggtgcaaaaaaatatgaccgcttacatgaagcgatcaagacatctatcttatggtccacaatcttctgttttatcttcggagcagctgccgctttattttcttcatccattatatcaggatttacagcaggcgatatagagatgatccaggccgggcaaacggcactgcgggcaaacggattttctttcctgctctttggtttctatactgtatactcatccctttttcttgccctcggaaaagcaaaggaaggttttatccttggtgcatgcaggcaaggaatttgttttgtccctgtcatcttattactgcctgcggtttggggcatcaacggaatcctttatgcccagcccattgctgatgtgatctctgcttttgtcacaattttcatggcactgtatcttcacagggaacttaagagtacagcagacattgctgtccaaatcagcaggaatccccaaccagacagtatgaaatatgagtcttaatcctgtctgtacaaaatccccgtttccatgcggtttgacggaacggggatttttctctctcgctcataaaaaaatattatgtatatttctttctaagtaattttaatattctttttaaagctttttttcaaaaagctaacctctgaaatcgattactatcaaaggttagctttgacaaaatataaaattaagcctttacaagctgttcacagtatcttttccatagtataccttaagaattaattctttcatctcttttgccgtcggctgaatcggattaaatggcgttgccacgtcactcattgctttctctgttaatttatccaaatttttaataaaagtgtcttcctgtaccttctctttcattgactttggaatattaattttctcactcagctcagcaactgcatccgccaatgattttttcccaataaatcctgcaagttcatcatacatttttttaacttcatcattccgactgttatattccaatccatatggaagcacaatcgcattggcaagcccatgaggcactccatattccgccccgaaagaatgagcaatcccatgaacaattcctaatccggaattagaaaatgcgattcctcccatacaggatgcggccagcatctctgctcccgcattttcatcttccggattttcgtacactttttccaggcttttatatccataaagaaaagcggccagggacatcgcctttgaaaatggatttgcagtcggcgttacataagattctattgcatgtgtcagggcatccattccggaagctgccgttaaactcttgggcattgttgccgtaaattcaggatctaaaacagcggcatccggaaccagccttccattcatgtctctgacagaatattttttcttttgtttcatatccttaattaaagctgcgcgggttgcctcgcttcctgttccggcagacgtagcaatacagcagacttttgctttcactcttaaattctctatgatattcggaggcattgtctcttccagtgtccgatacgcaggattctcataaaacacccacatagcttttgctgcgtccattgctgacccgccgccaaatccaataatccagtccggtttaaaagttttcattctttctgcaccctttaaaattgtttgaaaacttggctccggttcaacttctgtgtaggcctcgtattcaaaaccggcttcttctaaaacatccgtaacttttttataggagccgacatcgataagaacatttccgctcatgacaataaatgctcttttcctgggtccttccaatgtcttaagctgctgtaccgcattcttcccccagaatactttttcgcaccccaatttaatagaatacacgtgatcaccatcctttactctctagtaaacaatacaatttttaattactttttgggccgcatgttcaagtatcgcctcttccagctcctcaagcggatattccttttgaataaaatcatcactttggatcactcccatttttaacaattccaacgcagtctgaacatgtctcggcgttgtgtgaaatactcctttgaccgttatttgtgaatagtgcagaagagctgcatcaagagaaaggatacttttttcctttgttccgccgaacaaaagaacaaaaccggcttttctggccatcttaacactgctttcccatacattgatcagaccggtggcctcaattacaatatctgcacccctgcctccttctgtcatcgcttttactgcaaatgcgctgtcctcaatgtttgtaatatttaatatctcatgaaccccaagcttctttgcaagctccaatcgattttgtgccttatccgtaacaataacatgggcaccttttaacactgcaagcctcgcaaacatcaggccgatcggacctgcaccgtttaccgctaccacatcgcctaagtgaatgggacattcctcaataccgtatacagcacaggaaaatggttccatcagacaagcattcttatgagaaattgattcatccagcaaaaacatattctgttttacgattctctccggtacttttacatattctgcatatgtccctctgttaaataacatgtcttcgcacatagacggaaatccctttttacagaaatagcaatgattacatggggctgtattgtgaacagcaacccggtctccttctttgaaattcttgacctttttccccactgcggcaatcactcctgagtattcatgcccgaatggatgcggtggtttcaataaaggatatcctctcttatatatttttacatccgtcccacacgtagcagagatcttgttttttactaaaacatctccttccccgatttcagggacttcacattcttcaatccgaagatcttcctgttcatacaaaactgctcttctcattttcattcctgggctctgctcctctttaaattaacttggaaatcccggttccaaaaggaaaaccgggattggaacatcagtaacaattagatgtttgatcttctttgtctttcttaggctgtccatatgatttaaatttctccataaccacgtccatttcttcgtcgcttaaaacgaccggttcgccgactgacatcgcccgatactgcatttccgcacaaaattccatattcactgccagcccaaacgctttttcaatccccggtccgcaggtcaaaagcccgtgatttgcaagtaaaacagcttttccctttccgcaggctttgattgctgcctccgcaagctctggagttccgaatgtacagtatggtgcgcacggtacctctgctgttcctgcacctccgatgacataatgcagtgccttaatcggcatattaagacatgcaaacgttgtacaataagcagaatgtgtatgtacgactgcccctgcatccggtttatttacataaaagactgtgtgcaggccccattcactggaaggctttttatcaccttcaaccacatttccttctaaatccatcacaacgacatcctccgggacagtttcaaaatagcctacgccggacggactgattgccatcagcttttcttctgcattatagatactgatatttccgcttgtccctttgctgagaccggctgcactcatttttttgccgtactcgactaccaattctctttctttttttaatagcatattgttcccctttttaaaatgtgatctggtttaaattgacgatcatatcaccggtttttgtttcccagaaacgattaatcgtgtctgtcagaagttttggagattttggaagagcatcgacaacgtttccggcgttatgcggcgttaaagtaatattatccagtttcagtaacggatcatccttatccagcggttcattccaatacacatctaatgctgctccgccaatccttttattctctaatgcttctataaatgcttctttatccaggacctttgctctggatgtgttgatcagatacgccgtcggtttcataagactgataacttcttcattaatactgttttcagtctctggtgttactcttaaatgaagcgatataatatctgcttctctgaacacttcttctctctctttcattgttacagcaatgcctttggcattcatgacatcctgcgtcacaaaaggatcataagcaatgattttcatgccgatcccggcagctttttccgccactaaacgtccgatatgtcccagacctatgatccctactgtcatctctctcattgcagtggtatatgctgaattaacatactcttttctccagatgccctgtttcattgccgcatgggctcttgcaatgtttcttgtctctgcaaacattaaaccgaccgcaaaatctgatgtagcttccgcatttctgatcacatgcatcactggaatatttttttcagtcgcggcttccacatctacatgctccagacccccgcggcatgttccgatcaattttaggttttgagccctctcaattaattttctcggaacgggacaaaaatgtaccagcagaatatctgtatcttttatctcagtataaagttcttccgggatctcttctgcctccggtccccttgtttctatgtttaaagcctttttctgaaaatcctttcggtcatctgcattccatataatctctttaatttccggttcatcatcaatattcaggctttttgcggcttctgccagcaatccgctgctcacgatgatgtcccctactactgcaatcttcataatttcccctttcgtttcaaactatctttcacactgggtcttatgcagtttctccgcccgatgttcctgcggctgcctgtgctcctcccatcgcattgtgttctaaataatcccatactttttgtttattcttcttaaataatacgaagcacaaaagatagacagctatgaccagtccaataatgattgggttcatggttaggaatgcgtatgtaataagtcctgccgtacagtttgacaagataaatccgataattaaaacggttcctgcagtcacttcatatccggcatttactgcgatctcagtaaatacagctgcccaggaggatgccattaacagctttgcgcagaacacaatgcaggctgcaatccaggatttaaagatattgccgtttgacagagataccggtacttctaccatatatggaagagaaggtaaaaccatcaccggaagaacgacatttccaggcaaaatgaaggctaacagaagggcgaccgggataactaacaggcctgttgtcaatgtagccgcttctccatatcccaatgcatcatttactgcgatgataaactcccggtcctttccatactttgatttctttaatgtctttcttgagtaatccgtaatgaccgtaaatcctgaggcaaacaatcccgcaattttagggaagattgccattaccgctgaacaggtgactgcaacatctgcaacctgtccccatgaagtcatctcatttaaagtggagatatttccgacaattccgaggatcaggcccacgatcaagcctacatacattggttcacccaggaatccgattttcttcttgatcgcgtctggtcttaaattaattttatctgctcctaatttcccgagtataaagtctaagactaaatacagcggtacatcccccatgtgatgaggtgctatcattgcacagcctggatagtggtagtatgttgaccatctcttttgaacaatctccgcaagcagcaagacaaccaaattgacaaaaagcataagaacaaatgatatcacaagatttcctttgatctggtataacagcgatccccatacgatgattgagtaattattccaaagatccgacggctgaaaaatatctgtaatttttacaaggaagattacaatctggaagatcagcccgactccgataaacatcattccgatgtctgtcgaataagccaccgaagcaacggcctgccaccctacatccagcgccggcagattgattccagtctgttcaatcagttttgtcactaatgctgataatacgctgccaaacgcactggttataaacgccatacctttcaaaccgacaccgatcagcacagcagacataaaagccttttttaccggcgctttgaatattaaacaaataataaagatgataatcggcactgttatatagtttccgaatgtatcaaaaaacagtttcagtgtatcccacatatttcaacctcctcgtatgaatgttttcccgcttttcaaagctacagttccagattctctacctcctgcattaattcttcaataaattcctcttcattaatgcccacaaggaaacctgtggcattcaaaatgggaaccccgtagtttccttccacagggcttgtgtaaacgatcaagtcataaccgcctccctgcatggcacccggaacacctccgggactcacttccgtagcttccatctcatatcctttttcctcaaatatatctgctaattttgaagaaagcattgctgagctcaccgttcccgaaccgcacactgataatacttttattgctctcataatttctcttcctttctaatcttctaaaatttttaaacaatccaggatttctgatctgtctttagaatccctgattttcttcaacagctctccgtcttgaatgatcttcatcatctgcttcagcatactgatctgcatatctgagtctttgatcaccagaggaatgatcacttcacaatccagccacacatcttttgttcccattgcacaaaatcttacaggttctctgggtatgatgacacctaccgccggtttatttacatatgtattatttgtatggggaatcgcaatcgcaactccttttccgggcaaaccggtgggatatactttctcccggtctatcacagcttgtgtatatccttcttttacataccctttttcataaaaaatcgttccgccgagccgaatgcagtcttctgccgttttaacttctgcatccataactacaagttcttcatctagcagtttcaaaaatggtcacctctttcttttttagacttttatagaatatttggttatcgataacttaatttctaaatacactataacaccgatgttttttatcaaaaagagcagtttctttcactttttatttcgccggttttacattttttatacctgttttataagaaaaatatatcccataccgtaatggctgctccgaacacaataagcgcccctgcggcaaaacggacatacctgagtgttttggggattccgaatttttcatagttatgaaaatgcataaataccagaggccacttacataaacacatccctatgacaactaacggtatatgtgtccaccagccttccattgagaaaccaatgcttattaaattaacagcagcacatattccaataatgacatatgctttgagccttgacgcttgatcccatttaataaatctggacgttttgttataacagtccatactacagcactggacttcttctttttcccttttcagccaaacagctgccggctttttagtgattggctgcccacagtatatgcaccttttttccatagaaacctcctttcaaaggatgtctgatacctcctggtccggttctaaaattattgtaccttccccgccatccatataaatattagttttagaaccggcttcctccaatatatttttcacacccacaacagccggtatccctaatgcttttgcaaggatcactgtatgagatgtgttccctcctctttcagttacaaacccttttacatgtgctgtgtccatcctgatgatgtcttccggcgtcagatccgccgcgacaattacaatatcctcttttgtttttgaaacttcatccattggggaatttaatccttccatcttcctgatcaaagcatcacacacattttcgatgtcggtccccctctcccgcatatatggatcatccatactttgaaatattacagccgccgcttttttctcctcttctaaaacataaaccaggttcaatttttcattttgtatcctcctgataattttcccaaaaaaagcatcgtcatttaccatttcaatataagccagaaaaatgtttgcaggctcttctcctgctgaaatctctgcctctctatacagttgcttcagctcctccttgtattcttttcttaccgtttcaaaacggctgatttcatattctgcatcttcagacttttcagctctcgcttcaaaagccaaattgtttaaaaccagaatggtgccagcagcttttccttcagcacctccggttcctttccgttttttcatttcttaactcctttcatgtcaactataaaacttttccccttttcactctcacagtaacgataaataccttccagcacaggaaaatgtgtattctgatctacggtcacaaagaagatgaatatctttccttttatctcttcagatattttgattctttcttctgaaacaacaatttcataatttatttctacatttaaatctccgcgcataggacaatggagtattacgacatcctgagaaatttcataaaatttgattttgttatggttcatcatattgcataatctgttatacagacgcttccacgctttttcgccaaccgctttctggcatccctgcatgagcagctcttctttggtgctgcgtgcaggcagtacgctgtatctttgattttgaatataatttgcaatagaatttaattttttgtctatctttctgttatcagattcaaataatatccgcagcacatcaaaatatagttcattttcatcaacaatgccatttgtactctgaacggccgccgatatgatcctttgaattgttttgttatactcaccgatgaccccgcactgattcatgacctggatgatttttttcttatcagaatcctccaaaataacattggtaaacacaatatttttccggtgtgccagcagctctgaatatcccgtggaaatgatcagcgcaaaatcgtccaaattatattttttagcctcagaaataatgcccaatttaatgtcggcggtgctgccaaacagtgttttcagctgttcttttactaaagttgaggttgccattccatctgcgcagagtactaagaccttagagacattgcttttcttttgaattgtctgatacttctcatcgcttataaaatagattgttaagtatgcaatctcatctgatgttaacattttggcaagatcatctttcatctccctcacggctctcccagtgaaatcatatatttcgggatacattctcatgacatcctgaaccaggggatttgtcgattgcactccatatttcaatctataatacaatggtctgatatgcccttttaaccttgtcattaagcggtctttattatcaaaagaaatacaggcaatccgttcaaaatttacaaccagcgcttttgtaaaattagatatgtacagatcttcctgatcctgggaaacaaactgtgcaacctttatccctaacaagagagttgcaatataatatatttccgattcaggaatttctaagttataaacttttaatttttcaaaactctgtttcagtgattgatacggctttgtttcaactaaagttactttttcttctgtatgaagattcatcgtgtagccatccatgcttctgatccaggaaatcaggatcatgctgcattccagttcttcattttccaaaaccagtttgatattttcgtcttgttcatactgctttatcagacatctggcaatctccaggtaatcgtagtcctctccggttatcgtaaccaaagattgctgcatccattttttcaatatatccttaggctgaaaattttgtaatttcttaatttcctttcccacaatttttctgattgcaaattcttctccctggagtacatatccgaacttgatcgaactggctatagaaatattctggttacccaaaatttttttccactctttaatatcttttaagattgtatttttgctgacatcaaaaaggttctgcatcttctctattgttacaacctcagcagacagcagtatcattaagagttccagtattcttctctcttgtacagaataatagtagcttccgttcttcctcatctcagcttccagtatttcaattttctttgatttgacacagataatttttgactgtatctccagcctgcctaattccctgctcttaagccagtcattgatcagttcaaaatcatagtaaaatgttctctttgtaatgtttaatttctcaataattcggtcaaccgtataaccgtttttttgttctagtataatttttaaaatatatgccggtctgctttttaattccaaagcaatctactcctttaaattttcaataaattcactgattttctctcctgcttctttttcatctgttccgtttattacaagtttaatttttgttcctttacatatccctcctgacaaaatgctgataatactcttggaatcaatttccgtatcatttgtcctgatttttatatcactttcataagtttggcataacgtagataaatccgttgctggtctggcatgaagtcctgttttgttcttaatgatcatttctttttcgtacatgtctgctcctcctgattgtttcaattttatttgtgctttcattatattctctttcgttttttcagaaaatagcagttgttgtcactctttttttcttgttttgtgcaaatattgtactgaaaatggaaccttaatccgatagcaagttttctctttaaaaatgaaatacggatgcagccctgtgcacccgtttatatatgttatccctctaattaaaattataaaaaatgacccttggaaaacaatatataattttttccaaaggcctgtattaatataatcatatctgtctaaagctttttcaatatatctttcttatactccagaaattcttccgtcagattaaaatcttttctccggggcttaggctcccggatcacaatttcttccgtaatccttccgggtcttccggtcagcagataaatcctgtctgaaagcaggatcgcttcatcaatatcatgggtgataaacagtgtagacagatggatcttgtccatcacatccaaataccaccgatgcatatcacttttcgtcagtgtatccaatgcactgaaaggttcatccagcaaagccacattcttagaaaacatataggtcctcagaagcgcagccctctggcgcatacctcccgaaagctgtttcggatactttttctgagtgccttcgaggccaaactcctgaaaaagttccccggctttttgacgggcagcttttttgttctcacctttaatcaaaagcggcagtgctacattatcctcgattgtccgataagggagcagcagatctttctgaagcatataactgatattccccggctgtcccgtaatatccctgccgtccagcatgatttttccctgatcaggttttttcagtccggaaatcacattaaacaaagtcgtcttccctccgccgctggcacccagcagacagaccagttcattgtcatgcagctctatattaatgtcttctattatatttgtattctcatatgcaagcgtaacacccgttacagtcaaatccgacattttctttactccaagtagtcattggtaaatccggtattttccggaatctttgtttttgaaagacctttctcactgatccagttataaaatgcattccacctttctggattaatatagccccattgcttcacttcagccttatactgatccttcatatatttctggctggcctgtaccattttggaatccagttccggcgaggcttcgcagagaatatctcctgcatctttgggatcttcaatggcatactcatagcccttttttgcggctgacaaaaatgcttttgccgtttccggattctttttcatccattcactgttcccgatgatcaccggcgtataatagtcaaagaccggatcaatatctttaaacgcaaagtagtctgtatcaagtccggccacctccgtagcaatccctgcccatccatagtaaatccagatggcatccacttttttgctctttaatgcagagacctcatctgtgacagtgctcggaatcatgtttactttgctgaaattccctttatctttttctaccacctgttttaagatcgctttttcaatatcctgattccaagtggcgtattttttgccttccagccctttcggacgtttgattccgtcaccctttctggatacgatcccagaagtattgtgctgtaaaaccgctgccacagccttaatcggaagagcatcatccccaacgacagcaggcatcatcgtatcctgaaatgaaataccgaactgtgctttcccggagcccacaagcacttctgctccgtcttccggcggctgtacgatttccacatccagtccggcttctttaaaatatcctttttcctttgccacgtaaatacccgtgtgattggtattcggtgtccagtccaaaacaaatgtaatctttttaagctttccgtccccggcttcttctttctttgatccgcagccagtcattgctgtgatcaataacacagaaagtaatacagctaacattctctttttcataattatcatcctcttttcactttttcggctattcccggttctcccacggcatacattttttctgcagaagattcacggcccacatcagcaggagactgatcgcagaaatcataaagatcaccgcaaacattttgtcaaaggcaaaacctttcttaacccggatcatatagacacccaggccttcaaatccacccagccattctgaaatgacggctcccacaactgcataggaagctgaaatccgcaggctggcaaaaaactgactaagagatcccggaaatttcacataccggaatatctgcagctttgacgcacccatagaacgcatcagactgatcgtatccttgtccgccgagcggaaaccatccagcaggctcacggtaatcggaaaaaacgtcacgataacgattaaaattacttttggaagcatttcatatccaaaccacaatacaaggagcggcgcaatggccaccgtgggcaccgtctgcgtcagcacgatcagcggataaaatgccttatacagtttatcgaaatgatccatgagcactgccattaaaaaaccaataacaacacccatcagcagaccgataaacgattcaagtatggtcactctcgcattcgccatcagcagtggaaaatcatttacaaatgctctgaccacatccaccggcgaaggaagcagaaattttgaaaccatccctgtcccgctggcagtctgccacatagcaagaatcacaagaatcgccgctgccggccacagtttattggtggtgttttgtaacttttttatcaatggtaagcacatccccttctggcttataagacactttaatgtaagccgcaaccgacggcgcaccggcacggacagcaatatgctggcactctttcacaatatccatcagttcatcgtaatcaccctcgatcgcagtttcaaacggtcccacataataattcagtcccgtgctcttaatataatcaattacctcgtccacaatacggatcaattcttcatcattggccgcctccggcagtgtctggatcgctacgcttgcattcatatttcttcctcctcataaatctgtttccatagaaaaaccccgctggcaaatccaacggggaaatagtctcatgtacagctgtactgttttattcctacgctggcattacccagatcaggtataagggttaaagacctcttctcgtcttactctcagccggcagtctgccagcacccctgtatataaaattttcttatgtctcggtttcacggtatgtttgtattataatgaatatactgaattaaatcaattcccttttcgaaagaatgccaatctttccttgtcccgttcctttcgtttggttataataaatacagcagaataatcttatttacaaatcggaggaatttatgggcggattttttggtgtcacttcaaaacaggattgtgtttttgatttatattttgggacagactatcattcccatcttgggacaaggcgtgccggtatggcagtttacagtaaagacgacggttttgaccgtgccattcataacatagaaaatgctccgtttcggacaaagtttgacaaagacgtgaacaagatgcatggatatatgggcatcggctgtatttccgactacgaaccgcagccgctgatcgttcgctcccaccacggcacatacgcgatcatgaccgtaggaaagatcaataacacggatgaaattataaagcagatgtttgattcaggccacacacatttccttgaaatgagcggcggagatatcaatgcaacggagctggttgccgctatcatcaaccagaaagaacatctcgtggaaggaattcagcatgcacaggatgtcattgacggttccatgacgatcgtgctgctgacaccaaaaggcatctatgccgccagagacaaaatgggccgcacgccggtagccgtaggcaaaaaagacgatggctactgtatttcctttgaaagttttgcctatttgaatctcggatatgtggccgaccgggagcttggtccgggagagatcgtgattcttacacctgaaggtatccagactctggctaaacccggcgaagatatgaagatctgtactttcctctgggtttattatggttatccttcgtcctcttatgaaggaatcagtgtcgaggaaatgcgctatgaatgcggaaagaagctggctcagcgtgatgatgctactcccgatagagtcgcaggtgtacctgactcagggatcgctcacgccattggctatgccaacgaatccgggataccgttttccagaccgtttattaaatatacaccaacctggccgcgttcttttatgccgactatccaaagtaagagaaacctgatcgccaaaatgaaattgatcccggttcatgaactgatccaggataaaagcctattgttgatcgacgactccatcgtaagaggaacccagttgcgggaaacaaccgaattcctttatcagagcggtgcaaaagaagtacacgtccgcccggcttgtccgccgattttatatgggtgtaaatatttgaatttctcacgctctacttctgaaatggatctgatcacacgccggatcattgaacagatcagcggagattacaagaatgtacatctggagaagttttcaaatccggactctccggaatatcagggtatgatcgatgaaatctgtaagcagctgaatttcacatcgcttagatatcacaggctggatgatatgattgagtctgtgggattggatcctaaaaaactctgtacttattgttgggatgggaaagagtagataacataataaaaaacacagcttttgatgagattgattgtcaaatgctgtgttttttctttaattaattagaattgatataatttttatgtttatacaaaactcttgacagagtaaccatacagttttattaaggccttaatctgcaatgaattctggcataacgtcgacaatctaagactcaatatgtttctattaaaatcaaaaccattaatcggtacttctggtactgaaacctctaaattccaatatgtttctattatcaccgttcttgtttccacattaaatatgtaaaagaaatctttagactccaatgggttctattattactctttaaaaatggttggaattgcaaaaacagtgatctttagattccactatgtttctattaatacttgctgagacgataccggaaattctaaacacgctactttagattccactatgtttctataaatacgggtctatatatatcacacacaacttagaaaccactttagattccactatgtttctattaagataaatgctgtggatgtgctgataaaacaattcaaacgactctaaattccactatgtttctattaagatgtggttgcataccagcttattcttccggtcttctttcctctaaattccactatgtttctattaagattgaaacttcggtttgactccttaaaggcaactctctctaaattccactatgtttctattaatacttgaagtatctgtcctcgttcatgaagcaatcgtactttagattccactatgtttctattaataccccgtatctccacactaaagtaatacaagtaattcccaatccttaattgtcgacccaatctatttcattattttcatttggttataagctttatctattgctataaatgtagtataaaatggcttcaccactcacattgtcgagtcactgaaaatttcacagtatctgcggtcgacagtattcttacaaatcatgattcccactaccttctggaagttataactgctttatcctttcaatcgcctattaatatctgacgcactatataaaatatctgttacaattactctgtctccctcaattacataaaaaacagaataattatccactaacatgctccttatttctttgctatgttcaggctctgaatccataattcggttacgttctggcataatatccagtgttagtatcttatctgcaattcgattatattgttctatggcattttccggtgaaagaagattataagcaatatagttatataattgttccatgtctgcaattgcttcatctgcaatctgaactgtatactgcttcatgctaatgtttctttctaaattctgcaaatactttttctgcattctgcactcttcctgcttcaatatcatcatatcctttttgaagctttgcatgtaattcatcttctgtcattagatctacattaattgtatctggtgcttttggcaatgaaattgaaaaaggaatactacctgtaagagaaatctgatttaaatacatatcaatcgcagtcgacataggaactcctagcctcgataaaacagcctctgctctctcttttacttttggattgactcttaaatttaatgttgcagttttttccatgatataacacctcctattaagattattgtaacgtttttgtcgttacaattcaatcactatttctatttcaaatgcttttttctttttagagggttagaaattgtactaccattgcaaaccaatcaatctctaaattcctctatgtctctattaagataaaaataacccatgtataagccttagtagactttacacgagttatatatgttatattatacctatttatctcacttgtgctaaaaaacgcttaatcattgttacgtccgttttaagagaatctatatcttcacttccgtcttgataacgtttatatgtatcaaggtagcaagattcaatatctttcaaacgtgggataatctcagtttcctgagtaacttcaagattagttacacgctgtttaacatctttcatgtctcgttttatctcacatacatctttagataatgcatttacatccttagatagaattgtaagtatagagagtatttgctcctcgtttgtcatgttcatcaccttccttgctgaatatgtgcatggatataataatataataacataaaaatctgtgcaacgtctatttaatattcaagttgcttgctctaaattccactatgtttctattaagattaatacattttccgccttccaagcatcctttaaaatcctctaaattccactatgtttctattaagatgaatcaatcccaagcctttttcttgcttctttgatttctctaaattccactatgtttctattaaaattcgtgcggtttgttactattgcgcttgttgctacctctaaattccactatgtttctattaagattatttctatctaccgggagatgcagaaacatctttctctaaattccactatgtttctattaagatgtcgaaaaagctaaatgaagagcaagcatattacaactctaaattccactatgtttctattaagattacttccgaatcgctcatgctcttcgttgtggcatcctctaaattccactatgtttctattaagatactactgaattttaaaaatctgcaaacagaaatctactctaaattccactatgtttctattaagatgatgttgaaatagaagaggaggtgaccttaaatgcctctaaattccactatgtttctattaagatgagcaagatcagaaagtctgtcaatattgcaaaaaactctaaattccactatgtttctattaagattaaggagaaggccagagaacgtcttctcctttgtactctaaattccactatgtttctattaagatctgtctactaattgccttattcaattccccattccttctctaaattccactatgtttctattaagataaagatgggcaagtaattaaacgaaaaacatacgcctctaaattccactatgtttctattaagatggcttgcatcacaggccgacatgctggcagaagacctctaaattccactatgtttctattaagatgcgaaacaagtgtcgattgagcgctacgaacgagcacctctaaattccactatgtttctattaagatcaagctggccaatgcccaatttaaagcggcatcagcctctaaattccactatgtttctattaagattgtttttccgctggttaagctatcgcttctaactactctaaattccactatgtttctattaagattgtgacggccccgccggataaggtatcagaagagactctaaattccactatgtttctattaagatgcagagatctcttctgcatttttggaggcggatctctctaaattccactatgtttctattaagatccgttacattagaagcccctatttctcacctttaaacccctacaaattgtcgaccccataataatcattaactttcaacacaaagatacaaattatataagcatgaagtccctgttttattaagttactcgctactgtcgatctccctataattttgcactaccaagggtcgacagttcttatataagaaaactagtcttatcctcctctttcccccaaaattccttatccagccatctctcatgacgacttttgaaaataatgacggaatctaaatctttgtccacataaggcttcaattcctgctgtaattgtaccagctggaccttggatatctcgccctcaaaaacagaattttgtatatgtgacaaatatttcttacatatcttaaaaacccttgaccagcgtttttgtccattttcactttgactaatatcataaaccaaaactacatacataaactaccaccatatcttaaacccttcatactctttttccccgattaaatgcttaattaatttgtacgcttccagccgcattagatactgataagatacctttttccccaactccttgtgcataattgttgttttcagacgatcttcaaattctgtgacaatcaatttagacgcctctttttttaaatgaagaaaattcaactctttggtaaagctatcttccgttatctgcttccgattcaacaaagaaaatatcagccgatctccaatcaacggcttaaatacctcagataaatccaggcataaagaataccttctcgctcctggttcatgaagataactgattgtcgggtttaattgagtatgatatatttcacttaacgtctttgaataaatcaaagagtttacaaaagatatcagtgaattaatcatgttatccggtggatgcatgactcttttctcaaattgaatttcctggttgacgatttcattccaagctgtataataatatcttcggatgttaccctctattcccattaattcatcaacagcttttgcctttggtattttctttcgcagatgatctacttcattcataaattctgaaagttcttttcctctgctgttgtaatagcgtagatttcgatagatattatctgccgctgcattaataaatttacgtgcaatttcaattcttttttcataatctgtgtagtgctccacctgttttacgagaagctggcccgctagaagactttcttttggataataacttccggtataaaaattataataattaaagaaatgaatcgggataccatactgcgatatgtaattaataaatgctgtgttaaatgtcatctctgacattacataaatatcattaatccgttcaatgggaatgtctctcttttctccttcatatgaagtaaactgaagtgtattatcttttctctttaaatcgccattgttatatacataaaggcttctcttcatcctttcacctccctattagatgaaacataagtcatggtaagcacatttcttgcaaattttcttttcacagaactcaggtggtgtttctaattctttgatttcatgtatttcagaaataataccttctaatttcttaatatcctcttctttcaactcaacaatcaggtttttctttaacaatgggtaatcaattttagcctttaaattctttacgcctctcttccaaagatagtaaagataatatttcacttgccagactcctgcctcttcaatagatttacttttctttacttcatgcaattccttatgttcttttataaaatcgatattaataatattatcaatgttgatgtgtttttcatcacggcgatagctgttttcatctaacaacttacccagcataacactttcgttttcggcttccatatttatttcatgacagaaataccataatttcctcttacagacgaaatagtagtaaatcattactcctgtaattctctcctccataaaacgaaacctcccctttatattacaattaccaactagctattataaaattttatttctcactattttatagagtaaatataggctcatccatttcctctacatctaatggataaaatcccttttcatcataatgacagtctattaccggtatcgtctcaaaccgattaatttttatctctccaaaaatttcgatttcatgacgtttgtattttatatacatatatttcggtatggagactatatatcctttaagttgttcttgtatctctaatctccttttccacaagttatttaaaattagtttatcttttcctaatttcttttcctcttttatttgcttttctacatccattaaatttttttgcagcccttcaatactctctttataatccagatatacggactttggaacaatattttgagaaaagatatttcgtaagtcctgttcaccatcactaactttaacaccaatcttaaatttattaaaagtttcattgtattcttttaaatagtcactttcagaaactgcttccgtagtaaaatatttttcaatcaaagccagtttatcttcttcactgatcggaccatcacaatttgacaaagctttcatagattgcgtatataaaacagcatctaaaaagcctttccgccccctcttaacatctttaccgtcacaatacacaaagcaattatattcatcaatatctttctttccttttctattgcaccttcccattctctgaaacaatgcatttaattcagaaagttctgtaaataaataatcaaaatcaatatccaggcttacttcaacaactgacgttgcgatccaaatcccatcgcggctatccaggactccttgtttttcatctgaataggttttcccaaattctttgatttccgattccagctgctttctatcatttcgggtaaaacggctatgaaagacatttaaattcaaatctatatctgcttcttttaattcatcatacatttcctgtgcttttcggattgtattacagacaactaaaatcttattactgtgatttagcatcttattttttttataacattgaataatatcttctgcagataaggactcctgctttacctttatcgaatgtctcattaaattatttgaaaactgttgttctttaaattcaatccctgtatctcttcttaaaatatcttttaaaaatggagatagcgttgctgttacgattgcaatctttccgccaaattgatgtatcttccgaagtccaaaaaccaaataggccagtaattctgcatcatacatttgaatctcatcgatcacaatctttgaatatgcaagcgtgaccaatttcatctcatagcccttatacccaaaaataaagccaaataattggtctaatgtggaaatgtttaatggaagtgaaagtatttttccccgatctgaatattcaaaaatatctaactcttcactgtttgaaagatgctctctataatattctaatgcttctgaatgtaataatcccagacgttcatgaagtttttcttcttttaaaatatcatttttgacacgatcataaatagagttgatcgctacccgtacaggcagtacgaagaatcctttattgtctcctatccaatgaagtcctgcttccgtttttcccattcctgttggagccaaagcaataatatcatcttcacgatgctcaatacaaaattcctgcagctcattccatttactctttggattctttactttccatgcttgcatcatctggtcgagccccttaatcaagaaatcatttggatattcaacctgataatttccgctggcactgtaatcacatcgatgcagtaaaccttttaataaaatagtctgagggtctgaaggatatattcctacaagttcattttcatcatcgaattcatgcttatattcatccaacagcaatgaatcaattaagtcccttttctctcttaaaactttccattcttcacagtaatcatggtggtataaaatagcacaggcaactctcataaaatcctcatactgatatttcgatgaatgtaaataaaaagatgggtctaaataaaaaattgataaaatattgtgtggaacttctttttcaggattgaattttaattttccgtttcttactcttttctgaaattctttatttgccttgccgtcatcatggtgaagacaggcctggcataacaaatcaaagatatacttatcattaatataatgaaaatcccacaaaatctcagcttgtctaattaaatcttgcgcatgttctgcaattgttttatttggctttgccaggtactcctgtaacttcacctattcaccctccataaattataaaaaatttacaatattcttttgatcgtctatccaaatattttcactggtttttctgattttaaagtctgatgtatacactaccggaattttttcaataaaaatacgttttccgtcttggatttcatactttttccccaaataatatttagttccaaacattaatcgttccgggcccatccctgtatatattctcctgttcttcacatcatcatagtgcaagtaagcagaatatggactacgaactgtctcatcagtttcaagtaattctaccagctctgcatccgtaacttctacgaaatcttcactcctccctaatgattttaaatcataaatatgatgatagatgtcattcaaaacttcttcttcggcacgaatatgtaaaatcagctgcacattatccaaaatttcatagtacttaatggacgtagttaaggaacggaattttgagattggaactttatagttactcgtctcataatcagaaaccttcttcttccattctttctcttctgcctttatctgcttttctttctgaacaatctcatcatactcattgcttcctttttctgctgttttcttttgttctgctaacctgtttttctcctgtttataattttgaattcgctctttgtactctgtggatttccattccgcaatcttatttccaagaacttttaaatcccggtactcctgcagtaaagactcatcatgaacttggatcgtagtcccattaaaaaaactattcccttgagattttttagcactggcaacttgcgtaaatgcattagacagcatactctcgtttttcattttgaccaaagttcccctgtcatccattgtagagttcagaaaacaataatctctgtaaactttttttcgcatggaagagaatttgccttgaatgctgatatccatttttttatattcagtatatccgcaaatactgtgcagtgcaccgctaactgtggataacggaggtaatggatacgtcatcttattctctgttgtctcttcttttctataatttgcgctggcttgacgaatttttatccttaaggctttcaccccattcaccttctctcctatgtattagtttgaataatactcttctacttccttgcgcagttctttaaagaacgcgctgattgaaaccggcgccaattctttttctatttcatcttcgttttctaataagttgcctctcagcagtcccgcatggaatccttctttcagcttctctttcagatcttctgatatcatcaggtttgcatgtttgacatttaccacattttcaaaataatgtgtctttcttttagataatcctcctactatgaaaactggttctgcattatctaaattacctttcactgtcaaagataaattttctactgcatttaacagagctgttactctctctagtttctctgtctgggaagcttctccttcaaagttctcatctttccctatcatctgcaaatcaactgtcagactatatacttttaaggatttgtcgtattcatactgatacggcatcaatcccactttaccgccgctctcctgtacagacaatccattttcctttgcataatttgaggccatgtataagttattatgaaatcttgtttcatttataaaatgatctgctgcaatggcatccgtcagataaaaggaactttttcttacataggttgtcccctgggtattcatatacccgccctctagtgctctgcagttagcagcatttaattcagcatttacttttttttgcgctgctccatctacttcagtttcaagatcatcataccatccactctgaaccataatcgcattcttcagactttcccggcttctcatagaatatattttctggtttttaaaaactttttgtactgatgcaatattccccaggccttcagaataatttgatgtcatattggctactactgttaaagttaatgcattctttttcataattaatttcctcccttatcttctttcactgtctctgtattttcccttcttaatgcatttacaaatgtatatgcaacttctttgtttttctcaaagtcttcaaacaaatcatatgcaaaactaaaagattcgtctgcataatttgcaagattcaaaagtatcttgcaaaaacggtcataatcttcaaacgtaattgcacttgttaatttcttgttgtatgaacttaatttgttatccggaaccttataactgccattttcacgcttatctacaactgtttttgcacttttaaatgcagacttcatagctccatccattttgtcagccccctttatttttatgttgattttaattaactggttaataacatatccataattatttacatccggctttttcagcaaataatttattaaatgatcgagtaatgtaaagttaagaattgattctgtgacttccttctgaatatcaacccaataattctcagcttctttaatactgaaacatagatatttgtagctcttttccaaagatttcaagatctttaaactgtctcttcggatatataatgtttcaaaaaatgtctgatccggatttttgacaataacctcaacatcgccagtgataaatgtatccgattctaaaagcagcttaaaaaacatttgtctggtattcagtttttttccttctttttctgaaacctttttttcctgctgaacactttccgcccatctcccatttgtctctactaaacaggatagctctatattgtcattaatgaacatcatttctcttttaccatgaaacgcaaacggtatgaaatcaaaaacctgcatatctgttccatgaaaattagctttattaaaattgtatgaaatagattttcctttctttggcatatctatataatatcccaacagacggcagcattcttttccatcctcaaacagttgaaatgtattgcaatagtttcgatataaatttgttttgttcctaaaagtctcaagtgttatcatttctctattttcttcaattaaacttaaaacctctactgcattttccccgtcaaaggctaatttcttaaaaactttttttaagatggtatttcctttcatcttactattgaccaaagatatttgatcatccgatagatctggggtttgtaataattcttctatttgaaggtggtgcatatcatccgggaaagagtattctacaaattttgcaaactttgatttttgtatgtaacttccatcatactctaatttgtcctctttcaattcccagtctgaagcttcatcaccaagccatgtcagatacttctccaaacctacaatagctgcagagtatctccaatctaacggttctagctgttcccgtaattccttcatatactttccccctgccttaatacattgagggcaccgaatcctgctgaatgcttgctccctgccccggccgaatacaagtactgcaaaacatctgggtctcctgtcatttttataatcccaacagttacatctatataaactccataatgcaaaacaactaccttcttacactgaacaggctcaaggctaatgccggatgccttcttatctgaaaatcctgctaactttgcctgaacagataggacctccgaggctttctctttgaaatcttcatcctcaaaagtaatgaatcgatccctatttgtttcccgatcatgttcacgaatacacagaccatttcctaaaacagtttgcatatagactgtagactcggtaattaatttctcacttttttgatcgatacgttttagcaccattgcattgttgtttgccagtggaaaattcctgtttttaatgcccaaaaatgctgaaaatagtatcaagcctgtcttccttcggtcatcacaagaaaataagatttttattcttggttcttctaaaaggattttatctttagagaatttaggccctttcatcaaaacagaaaaacagtaatctttttggatcgtatctttaaagtacttttcaaaatactttccgtcattgcactcgctaagcgcaaactttaaatacgacaatacaattcttctataatctttgcttagttcaggcttttcaagatccaattgtaactctagacgcatatttattttcctccttttgcttcctttatctgtataatactaccacttattatatttgtcaatattaaaccttatataataatgctatttattttaaaatgaaaaaatttgaataagttaagtttttatattataatcaaataggttaataatatagtttatacataatgggatttagagtatataataattctataatagtactaataggccatagtggatattttaaaaaattataatgaactgaaaagcaatattttgtacggtgacaatacttacattgtttccgtatttttaatattaacagcatacttcttcctgtttgctatctaagttcattcaaacttttatatttctattattacttgtaccgaacacatttcagagttagaacggtttagtcttctaattccaatatggctctattattacgaccatatcaaagtggcgatccaaggatataactactttagattccaatgtggttctattattactaactctccgttaaagatattgtacccggcatattcctctaaattccaatgtggatctattattaccaaaaaagcctacaccattgtagaagaaaagaacggactctaaattccaatgtggatctattattacctcgatctgttgattgaacgcctcctcatagtcatactctaaattccaatgtggatctattattacgcgatggatactggtgcaacctcaggggctggtacctctaaattccaatgtggatctattattacatatgtgttgctctttaaaaacggcgtattggaatcctctaaattccaatgtggatctattattacccgattacgaaattatctacgaattacgaaaccaccctctaaattccaatgtggatctattattacttttatccccttttatagctttgcattcgataaaaactctaaattccaatgtggatctattattaccctgcccgccggagcgggctaaaacaggatgcctaacctctaaattccaatgtggatctattattacgcagaagggaggaataaaaaatgaaatatagaatctctaaattccaatgtggatctattattaccaaagtcccagggaattttatttgtgatgataatgtcctctaaattccaatgtggatctattattacccatacattcacaatatagcaaaaataagcatttttcaacccccatttgtcggcctgcaaagattaccgcatttttcataactttaaccttcaaccctgcttataatttttacatttcacgcctctattccgcccgttgtcgaccccctggtatttttacattataacaggttgacagaatgtccctcatccttacagatcaaccgtttcctaattgattatctttcttataacatctatgatctgacactcgatagaaccttctgaatcaactctcaaaataattctttcttcttcaaaatcatattcagccatttttcttcatctctccccggtcttacatcagacgtgatccatgtttcctcaacaataaaaactccagcttcatctgccaatctgtgcagtcgttcctcattcaaatccgtaaagtatcttccattccgctctccctcaaattctccatatttaaaagaggcatatacaaccccctgattcctcaacgcttttgccattttcggaaaaacttctttcagctcatctatcggcaaatgaagaatagaagaacaggcccagatcccatcatacctatcctcctcatccagttcataaaagtatctgtgctgcacctcgattcccgtaaaatccgaagccatcctgcacagttcctctgatccgtccatcgcatccacttgataaccctgactcataaaatgcttagtatcacgaccggatccgcagccaaagtcaaggatcaatgcccctttcggaagcctttcacagaaacacttctgatgatactccatatttgctccaactgtattagagacaaattctccggcattttcgttgtaatacttgattgtcttagagtgcataactcctccgcttaaatctgtctatttcaacaattccttcagttcttctctggtaaagcttgcgcttcccattccttctccgcccaaaatctgatctgccagttcctttttcttttcctgaagcttcacaatgttgtcttcaatcgttccctcaacgatcagccggtagaccataaccacgttttcctgtccgatccggtgtgccctgtccgtggcctgattctgtacggccagattccaccacggatcataatgaatcacgatatccgcagaagtaagatttaacccggtgcctccagcctttagggaaatgcagaagaccgaagtatcatcgttgttgaagtcttccaccatccgggcccgtttttctttatttactgatccggtaagcgtatagaacgaaattttttcagcttgcagccgctcttctaatatagaaatcatggatgtaaactgagaaaaaaggagaatcttatgtcctccgctgactgcattttttataagatcaatacacaggtcggattttacagattttcctgtatattgatcaaagaccaattccggactgcagcaaagctgtcttaaccgggtaagttcagatagtatctggatcttggaacttttaaattcctcttccgactgcttatccagcatcagctgcatccgttttacatgggcatcataaagcttctgctgttctccttccatcctggcgtaatagtttttttccagtttgtccggcagatctttcagcacatccttttttaagcgccgcagcacgaacggcctgatcatcttttgaagacgctttatctcattctcgctgttatcctgtacgatcggaagctccagttcttcccggaacctctgataagaatataaaaatcccggcataagatagtcaaaaatactccaaagttcactcagacggttttccaccggagttccggtaagggccagtttaaagccagcatttaccatcttgaccgctttggcagcctgagtattatgattcttaatatactgagcctcatcaatgatctggctgctgaaggtcatattttcatagagcccgatatcccgctttaagagatcataggaagttacaagaatatcccggttgcctgcatgtctgataatagactttctttctccggccttgcccacaaccattcggaccggaagatccggggcaaacttccggatctcgctctgccagttaaataccagcgatgcaggagccacgatcaggcttggactgtttccttccttctccaggtattcggacaacagaaatgcgattacttgaagtgtctttccaagccccatgtcgtctgccaggattccgccgaatccattgtattttaaagtcttgatccacaaaaatcctcttttttgatattctctcaagataggttccatctcggcagggagttcaaaatcattatcctccaccgttttcatgttccgtatcagtgccttaaattctttatctttgtgggcggaaaccgactgccattctttcagctcctcgtccaggtaaagggcatggtatttcggaaggaccacctgctcctgttccagctgcttttttgtcaggtgaagcccttctttcatttccagaagggcattgatcccctcaccttccatgtttacaaaatcaccgctctttaaacggtaaaatttctttttccgattatactttgataagatctccaaaagttcgtttctcggcatatctcccgcggtcatctttaactccagcagatcaccggagagagatacacccaccgccactttcggtgcaggcgcaatattaatttttttcagggcgtcggaaatatatacttccgcaaactgctgcatagcaggtatcccgcagaccagcagttcatagagcatatcctcatcattggccaggaccatcattttttcatcctcatcgtaggcattacagtaatgggaaacgatcttggcggcctctgcttcttttttcagatcccgcccctctgttttctggttcttttcaaaaacatggtacttctgttccccgtataccgcatccagcctgcatgtaataaagtccttttggggcgcatccagatatatttcaaatgcggccggcactaccccatagtccttctcgtcaaaactctctcttgtacactcaaaatacgtttccagcacgggcagggcttccctgcagaacacaggcacatctgctgtttctataaaaaccttccgctgcggcatattttccatacaggataaaaaatcgtggacaggctccaaaaacgctctgctcactttgtagatctttcctttggaaaaataaatattatgtttgatgccctgatatccgaacaaataattgacctctacgttaattccctgttcctggcctttgatcttcatggtcctggacagtggatcctctgtcacatgccagagtttctccggcatcccattgatttccgccggaaactcccggtctcccaccgcttccaaaaacaattccagctctccggttgtcagcgggacctttcttactttcattgttgaatccgtatatgagtatccataataaggcacctgcatatacttgatcctgttttgggcagtccacgactgtaaaaattccgccagtttccgtgaatctcgatcaaatacctggatatcatgtataaattctaacttctgcccataagcgaatttctgtttattttgcaaagcatctgcaaaggcaaaaacatcttttaaaacatacagataggaagtaccgatcttaaactccacctgaataaaattatccatacatgtcaaaagtggttccagatgtaccttcccataaatagactcctgggcaatcggcagggtgcttttaagctgctgctgtgaaagaaatgccttgatcgccggagtcgtctttggcctccattcctcactggccgaaagtttattctgcatgcctttcattgtctgaagttttgcaaggctttcttctttcttctgttcatactgccaggcggcttcctgtgtttccaggtaatctgtatattcaaacaagacagccacacagtgcttgcataacccctcatattctctgaacgccggacatgtgcagtgcgcattttccagccacccttcttccatattatattccaaatcgacatcgtacatatttctgccgctgccctggacggcggcgtatatataatcaattccgccgtcttcctctacggaatattcctgaacagcatctgaacgataaaggtttcttcctctcttataagcattttgatctgccaatgcccgtatttctgattgatccaacatcttaccgcaaccgccctttccatatactcttatatccattatatgttataaagaaagggcaatcaaattagttttcatcagacagcttcagattcagatttttatttctttaaattctgtcagctgatctgcgttcataagatacatgtaagcatcctccaaagaaatttcaggttgataacactccgctgacggcttttgtccgctgatgattttaaccttcatgccgtcttccgtaaactgtttggaagaaatatgatatttcttttccagttccctcgcttctttctcatccttcactctgcagatccagatatggccttttgccgcctgcatcatgtctgttacagaacctgtataaaggaattttcctttcttcatgattgcaagcttttgacaggttgcagtaaggtcttccaccacatgagttgaaaaaagtaccgttctgtcttcagaaaaatcaacaagcaagttccggattcttactctttcttccgggtcaagccctgttgtaggctcatctacgattaaaaactccggatcatttaataaagcctggatcagtccgacccggcgtttcattccgccggaaagctgcctcatttttttctttctatgttctttaagactcgtcttatcaaggtaatattcaattctttttttacattctttctttgtcatgccagacagcccgcccatatattccaggcattcctgtacggtcaggcttggatagagatttaattcctggggtaaataccctatttttctgcggattttttcgtaatttgcttcagtataccgtaagttgtcaagatatacatcaccctcactttgtttgagtaccgtagtcagtacacgcataagtgtggtcttacctgcctgtgtcaagtaagaaccaaaaaaaatataataatattcttaaaaaagcacagctaataagcaagttctattgctgattagttctatttttttaatggtacaccgcaccataaactggtgcggctgaatattatctcaccccttgtaccatgggaacatgtagattaggtataaccacaaccttcctgacactttacagcacccttactcactgttcatgcctccagcgctacctggaccgtgattctattattacggaggtatcattatcattctgggttttagaccgctggttatatggtccaagaaaaagtgccgctcatacctttacttcttctattacgattcctgacatttaccttgtagttatattcaaggcaggtatatcgtggcgcagctcattgctcttcttcatgcttttaagcatgtcccaaatgtttagtatctcaaaagatgaattccaacatgtcatttatgtcataataaagttagaatgcatctaccatgctgatattctattgtcaaggtacaaacctgaattatccaattcagtaaccacatcagttatacataactaaatcatttgatgtgtatgaacctattctacgatgattttctctttttatccattgactgacagtccattgaccccgaaaaattgatgaagaaaatttctgtggtatttcaggaggtttatttatttcaggatacgattgcaaacaatatacgctatggaaaaaaatgccactcatgaagaaattgaacaggcagcaaaattggcaaactgctataatttcattatggagcagccccaaggctttcatactatgattggtgagggtggttctactttatccggtggtgaaaagcaccgtatttctattggaagagccatgctgaaaaatacggctgttgtattgcttgacgaaaaacttttatacacgattaaaatgatagtcataaactaaaatataaatatccctgattaaccttgtagtgtcaatcagggatattcctgcatacttctcttattttacaatttcattttgattagtggttagcagcccctccatggtttgtattacgtaaatattttcacgtttcatgtgactttttctatgttttactagttcatggtaatgatatgttgatacggaaataaaattacaaaaccagtccacactgtcccagcatagagccagcatcgaatctagtttatattttaacatatgaaagcgtacggagaccgtttttcttcttttatgcatgaataaggagagctgcggttccataactgatttctcaactattttgcaacagccccatcaacttgtaatttaaacagttcttctggcttcatatgctggataattatgatgtgtatttctcttatgattcccagcactactcttttcgtggtttcttatgatatccatattgttttttattgtttctacagtattcaataaaaattccacctccacttccgagcattcttttaatattgataatagacgcaacactaaatcggaatgtatttcgctcttttctgtttccgttatcataatggggactgcatttaacgcgtacaaaattttgctatatgttttcataccaatcattctggaaccactctccactttgcttaagtggcttaacgaaatttcagctgactcagctaattcttcctgtgtcatatctctttcctcgcgcagccttttaatttcttctgctatggaataaacctggtgtatcatacgttctgttcacctctaatcaatgtgtgttttcatcttcctcttttcttaacagatgtctttttagtttctggaatgtctcatcactgattgcatgttccagccggcaagcctcttcttccgcaatggcagggtcgattccggcatcaataagctgattcgtaaagaattggtgacgctcaaatattgtttcagctatttcacggcccgcaacggttaaatgaagatagccgtcagtgtccgttgtcaaataaccgccattacgtagaaccgtcactgcatggctgatgctgggtttggcataccccatgtgccgggcgagatcaaccgaacgtaccatacctttttgcttttgcagaattaacaccgcttccagataattctctcctgattcatgaagtttcagcgctgcatcacctcctgtgtttcgatactgtttagaaaaacagatttcttacttccctgaagcttttaacgcatccattcttctaaactcatttatcatcataccaaccgcaacaataaatactatcacatccgtaataaacggagcagcaaatacgccatgtacaccaaatccggcaatataaggcatgatgatggctgctggtatgtaaatggctatctggcgtaaaataaccagaacactcgcttttgtagctcttccgagagactgcatcagggtcagaaccacaatccagactcctaataaaatatatgacaggaagaacagacggaaatcccctactcccagttccactacggacggcgttgtaataaacatagagagaattgtattcggtactaacataatcggcaaatagaaaataagcgctaataaagttgctgtgattgcaaacactttcgtgatgtgctttacccggtcgtattgttttgcaccataattggttccgaccgccggctgatatccctgggaaagcccccataaaggaataaatgcaaaagacactacccggtatgttgcgccgagtataatctgccatgtatctcctccatgctgcgccgcaagattataaagtgcggtttgctggaccagcatcatcacctgcatcagcatcgcagaaaaacctactccgatgatttccgagaaaagcgttctttcaatgcgaattgcattgattctcacagtcttactccttcgcttaaaataccaaagagaagccattgcatacgcaacctgcgaagccactgttgcatatgcaactccatcaattcccatgccataaggttttagaagtaaaatgaaaatcgggtcaagtataatattcatgatagcggaaccggcgctaaagagcattgcctgtttcaacaatccctcaccacgcataatcatatttgaggactgtgcaaaattgacaaacagactgcctgcaaagatgatgcgtaaataccggagtgccagctccagaatttctccgcttgcaccagaaagcattaaaatctgtttcgtaaaaatcatgcctatcgccatgatgataagagaaaaaatcaaattcatggcgatcagatttcccattatcttgtcaattgtagactgatccctttttccaatcgccctggataggattgaagcggagccgataccgatgagcgtggaaatcccactattggcaagcgtaaatggataggacacagaaaccgctgccatagcgttatctcctaccatttgtccgacataaactccatccataaaattgtaaagcccaacaaccaccatgccgataatcgcaggtacgctaagttttaatactaaactttgcgggctgtcatgaagcaacatagaccgagtatcatttttatttaacatagaatcacttccttatctttttaactgtccatattttaagtaacaccttagactgaccagccaagactttcctgctgtatgtagaataatttgctgtacagtcctttttgttcaagaagctctttgtgtgtcccctgttccatcagttccccctcgttcaataccaggatttggtcggcatctactactgtccgcagacgatgggcaatcattataactgttttcccttctacaagtctggcaatggcctgttgaatcaatacctcgttctccgggtcaagggaagcggttgcctcgtccagcagaataatgggagcattttttaatagtgcgcgggcaatggaaatacgctgcctctctccgcctgacaaggtactgccattttcaccaaggatcgtgtcatacccctccggcagccgtctgataaactcatcacaatgagctgcttttgcagccgatacaacctgctcatcactggcattcatatttccaattctaatattattaaataccgtgtcattaaataaggtcacatcctgaaaaacaaatgacatgctacgcattaaatattctggttcaatttgtttcaggtccttaccgccgattgtcacagtacctttatctacatcccaaaagcgggcaatgagttttgccagggtactctttccgcttccggacggtccaactagggcagtaatgctacctgtatttatttttgccgaaacattttttactacatcttcttttccataggcaaatgtaacctgatttaactcgatatcataatccttaatgtcctgttcttctccctccattgccggtgttgtcagcagtatacgcatccgctttgtaaccgttcccagatggaacaaactggtaagctgtgataggatagataatatcggtccataaatttgtgtagaaaacatcaataaaaccaggagggggtataattcaatctgtccacctgtaatcaggactgtaccgataaatatagtgattcccaggcttgcctgtaaaatcaggctcgcacattgcacaagaatacctgaagccaattccactttaattgccgtctttttcattgccaggagagccttattcagtgtctgaaaacgttctccgctcaagccacaggatttgataatcttgattccctccaaatactcctgaatctgactggacgccgccagtttcacccccacctgctggtcaaacaggtgtaattgcagtttacggccgcaccatattataaagaagcagacaggcatggtacaaaatattgctaatgccatgcgccagtcaaaaaaggccagacatacgcatgtaagtgtaaccgatataatatttgctatgagcggaggaatcgtactgctaagcatggattccatgctggcacaatcagccatcatatttgtagttatatctgacaagtcttttgtgttaaaaaagctcataggaagccttcttaaatgttcagcaatccgtaaccgcgtgttgcttgcttccttatatgacgcaaggtaagtttttttataatcattcttggcagcgataaagaccaggattgtagcaagcactccgatcaccaatagtacccacatagttgaccaggatatctcctgccccataaagggctttaaaagctggccgaacaacagaattggaatcgcagatgaaagcataatggacaggtttgtcaatgtgcaggcaaaaatcgcttttttaaggtctgaatatcctttatcagataataacagtcgttcttgtaaaaatttcatttcgttacaccgccttccctgtatggattttccaattgactgattctacataactgttccacatctgcgtgtatttttcgccatttgctattaatccatcatggattccctgttcaatgagatgtccctgctctataacaagaatctggtcggcgttacgaatcgtggaaagtcggtgggcaatcataaccactgttttgtctttaatcaatttctcaaaagctttctgtattaaatattcattttccggatcgctaaatgcagttgcctcatccagtactatgatgggggaatccttaattatggccctggcaatggcaatcctctgccgttccccgccagacaagcggattcctgaagaaccaattaccgtatgatacccattcggcaatttttcgatgaattcgtgacactgggccgcctttgcagcctctataacctgctcttctgttgcatcaggatttcccatccgaatattatccaaaacactttgtttaaaaagaaatgtgtcctgaaatacaaaaccaacctgcttcatcagttccgcaaggggaatttcacggatatctactcctccaatttgaatatttccctctgtcacgtcccaaaaacgggaaatcaaattagcaatggtgctctttcctcctcctgacgggccaacgattgctgtcacctctccctgtctggcatgaaacgatacgttatccagcgccttaacaaccacatctgcttcagcttcataagaaaaactcacatgatcaaagacaatatccttcccctgctccttgacgccgcctctgtaatccggcaaaacaggtatatgtaaaatttcttccatacgctccacattgccgtcaatctgggtaaatgactccgaaatgaacatgatcttatttaagatgccagatatggccggcactaaaatcaaataaaagataaaggttagggagtagtttctgtaatctgtcacatttcttccaatcaatatacctacaggaatcagcaacaaatagatgctgtggataatcgctgtaaacgccggcatgcaattcctccaccccatggcatattccaatatgaaggaggtgtaatcagttatggatctgcttaatcttttaaatgaatctgccgtctgattaaaggctttgatttcaggcatccctcgcacatattccacagatgcattattcatatcttcctgggcagactgaaaacggtgcatcttctctttggccgccccattgaatcctgaaaattgaatggcaaaggccagcacaattccaagaagagagacaacaccataacgccagtcaacagccaaaagaattatgactaaaataagcggagccacaagagatgcaacaaaatccgggaattgatgggcgataaatttttcgatactttctatattctcgtccataattttcctcatacggccgcttccaatggtcaggtgatatcctaacgggattgcagtgatatgatccgcaaagtttaatttcagttcatacaatgttccaaaggctgccagatgggaacacatcagagcacagaaataaagtaccacatttccagcaatgccggccagggcaaaccagccgcacatcaaaatggcaggcatatctgctgcaggcatatccggaaacaccaaaatcagttccctgataacaaaatagattgacagataaggtataaacgaacatactgccgccaatgcagacagaattcctgaaataatcactaaccctttgtgttctgatgccagctccaggcaacgtgccattcctgttttccttttttcctccttgttcttttcctgtttcattgttgctcctccaattccataatatttgcactatagttagattttactaactgtagtgtattataacgaaaaaatccgcggttctctactccatttcaaaataacttcccgaaaatagcccgaaatttcaacaactttatcctcttacagatagctcaataccccattttctccagtagataatcggcagaatttatcacaaaatcgtctgtcaccttcccctcttccaacctgattgctctctggcagcaagacagcacacattctgcatcatgggtaatcaccagaattgtacgtcctctcccagcaagttcctgaataacatggcttacctttctcatatttaccccgtcaaggccgctggttggttcatctaagataataatgggggcttcatgcatcaacgccaccgccaatgcgagcctctgtttttgcccccctgacaaagtggacgggtgttgttctctaaactcatacaaatccagttcagttaatatctgcccagccttttcccttatttccggtgattctttactgcccagtatcagttcgtctatcagatcctcaccaaacaactggctgtcgagatcctggggaatataccagaccgttcccctcctcttttttatgttgcttttatttccaaacagagtaacacggccggaatcttcttttaataatccggagagcatttttcccattgtacttttccccatcccattggaacctatgatagcgatagattctcctctcctgcaggaaaagctgatatggtctgcaaccactaatttgccaaacgttttacataaatcttttacttctaaaatcacatcgctgttattttcaaatggcatatgagaacaagtcaccgtatgcaggtcagggtttcttaaacccagcttacggatttcttccgcggccagctgcctgatttcagcctgcgtaaattcatgcataacgcggccatcttttatatacagaaacctgtctgcaattggcatcaagtaataaagtctatgttccgcaatcagaattgtttttcccttttccttcagtttccttattgtattacccaatctctctgttgaatccgtatctaaatttgcggagggttcatccataacataaatttcaggctcgattgcttcggcagaagcaatcgccaccttctgtctcattccataggaaaggttccgaatattataatttaatatattatttatgcccatactatcggctgaagcttggacatgggccacaatttcttcgtgcgaatacccgtaattctcacatccgaacgcaatctcccctgccacctcattggcaaaaaattggctccgtggatcctgaaacacattgcctataatcttccccctctcccaggatggataactggaaaggggctgtttctctacattgacggtcccttttaaatcgccctcataaaaataaggaatcagtccattaataactcgggtcagcgaacttttcccactgcctgacggaccggttataaccaccgtttcccctgccttaatatttaaattgatatcagtaagctggggaattttatgctgatatgaaaatgtcacatgctgcatttctatttcttttcccatttttattctccatattcttattagcttctcagctttctataatcttttggcaaaataccatagacatctttaaatgcaacagaaaacttacttgcattggaataccccaatgaaaaggcaatttcaccaattttcatttcaccatctaaaatcagctttttcgcaatccccattttgtatttcttcaaaaatgcatatggggaatctccataaacgtgattaaatattgtttgaaacatggtagtccccatatttttttctttcaccaattgtttaagtgaacgctcctcgtctaaatgagtaatcatgtagttccagatttctttgactgcctcgatctggtctttgggataatactgttccttctcagcgtcatttcgttcaatattttgcaaatagaaaagaagttccaacgttttaattgcaaagtagcaagtgctctctttcccttttgcctcatagacttcatcaaacaatcgctgtaatttagaaggaatattgctgatataccatgcagtgttcaatgataatttttcctcaatcgccttaatgtctatggaaaaatccgccataatctttttcgtggacaaactcatttttttctcgtcaatcaccagagtaacggcatcaaagtaaccgaaggggaaataataggaagctggcagatgctccccgctgccaatccagaaatggtcctccgacagatgggcacatatattatttgcaaattcacagacaactctccccctgcggcaacaggtaatctccagaatctcgctgtatggggttactggaataaaagcatcttcggaattaaactccatgaataccatttccattccctcaaatactttatatgtaacaatcaaaccctttccctggcattcgtaccgttctattaagcaatcactgtcactgtgcataaccctggcgttccggccgtaccattcctgcacttcctgtttttccggcatggttttaatcctccattatgcttctatcatattgcagattatctgcggtttcctgctcagagcctccgcgtgtcccattttctcacaggcacggactttaagaggataaatactgactcttcttattaaaccaacagaattgggggcatatgtttcattgcctccatacataatcaccacttccattgatattttctctttcctgctccggatatcatacttgtaagctgcaagagctgtctgtaataatgttccaaagattataccggcctcccccattggctgaagaacctggacatcattgttatgtaaataccccatttgtttttgcatatacttcatcatgtgctttccatgcaaaacccgcttcatctgccacgccataataaggctgtatatgtatttcatattacccatagattcatattgtccgccgtccagtatcagtttttttattcttatatcacctttgagtgcaagttcaagtgcaatacttgctcccaaagaaatgccataaactgtatcaacataattaattccctttttcagcaatgcagtactgatatagtcggcactaagaatgacagaagtaaccgcaccactggacgaagcactatggcctggcaactccggaattataaaataataatctttccccaatatatgaagaaccttatcaaaacagttcttccaattgaatcccatcccatgtatgagaagtattcttttaccgtttttattaccaagcagatgaatcttagattgatccttcttcataggtttcctctttctccaatattttatcggtcaaaaccaggtcgatatttaattgtggtaaatcatgtattacagtttctaaatccacgatatccatagcataatgaattccgaagtccggttgtttttcaaccagggccttaaccgtataagcggctataattgaactgatatcactactgtatgaactatgtacgtccgcagttcttatgtgaccctgattattatctgaacctgttacttcaatatgtatatagttatatgctgctgttgagccaccagtcatttcaaatagcttgataatagaatcaatactttgctgcagtgcctcatcgccttgctttaaaccatatttgataactgcttcctgcattaacttcgtgatttcttctccaaaagaggcgtaataccagtttgccctctcaggtttatatttttgagtaatccgttgcaattctatcgtatagtagttctgcaatgtatactccttattttctacaatcctgtagattggtgtttcatccctttttaattcaccattttcataatagtttaatgcagttccaaatccggctgtatttgtcaaaataaaatctttgattgccgatctgctcggaatttcattcgtgatgctcaaccccataatacaatctactgactttaagctctcacataaatatttcatcaacaggccagtcattcctgggaagaagccactggaaagcacataaaccgattcgttctctatatctgctattctgtcttctaaaaatgcctcaccagaagggtccacaacaggtatgtgatatttagccgctgctcttgcaatcttttctccattgacaaaggaggctcctgcacaatttacgataatactgcactgactgcaaaagctttctaagtcatcagatatatctacatctaattggatatattggttatgggcagtaactgatggttttaccgaatgataggaaactagcaactcatattgattctccaacagtttaacaactctttttcctatttcaccagttccgcctaatatcccgactttcttcatattccgccccttttccagggtgtccatacggtgatgggcaccctttggcaatcgttaatagttaaaatctaaaatcttagaaatattcttttccagattatcaccaataatacaatcaaaatgttgtcctgcaattgtattatattttaaattccccttgatatatggtttccatgtttcaaaatcttcctcaaaaaatcccggataaaagtggcttcctaaaatctcacaacagaaaatccttatatttccatagtaaagcttcggtatataactggacacacatctgaaattttgtgagaatatccggaaaagtacattcagcatcttcagctgatgttccatcaactccccatttggacgctcaatcgtgcggtataaagcatttaacctttctgaaattgtatagctggcgagccggcggaactcttcagccacatcttcatactccccgcccgtttcgcataatgcttttactgtaatttcaccacttccacatctggaaatatactctatatactgctgcaaccgctcatcgcttacctgatatcctgccttatatgcatctgccccaatcactcttgcaaaaatcctctccaacagcagttcgttatccaggcttgaatgcaatgcattacggaatatctcatccgatgcatccgctaaaatcgtgttctctttccgctttggaataccggtgcttatcagcgtcacatcagaaacggaaattcctttatttctcaaatattgtgctgtttccagtgcaatcagaccacccacgcaatggcccacaagaatataatttttatatcccattttttccaatatctcaccatatttcctccccaacaaccggaaggtctggctggtttccatagaaatatactctgcatcatttccaaaaacaaagccgataatgctttcactgtccttgctgtcctcttttatgcgagacagtaaatccgtatagggtgttaaggttcccgctccggcatggaaaaaaaccttcgcaacagaatcctcattatttaaactgctatttttcagaatcattaaggacgggtcctcaagatttcccttatcattttgatggttcaaaaggctttctgctatctgcttaatagtgggtgctttcatcatttctgtcagaaggttgctccactcccagccggaggcttccgatatgttctccatcatcttcccaatgatttgagcaattaacagagaatcaccgcccaccagatagaaatcatcatttctccccacagaagtaatccccagctctttgcaccatatttcggcaatgcgccgctccagatctgtctggggcaactcgtcctttttcttgatattctccttatggtcccaactcttgaagtattctttgatttttctggtatccactttacggtttgcagatagtggcatatccggaagaatcagaatctggtttggaaccatgtacggagatactgtactttccaaatagcctctgaccgcctccttttctaactgctcatattctccggcaaagcgaaccacatatattgtctgtccagctaagtccaatttgctacccttatcagggaattcataaagcagctgcccatcatgcctcttaaatatatcttcccactgttttcgtgtgaagaatgtctggtcatgttcgctgcgttcgtccgtaaaaccggttaagccgtccttaaattccattgacgtaagcaacaggtaacttgttcgtgtttcctcaagtatgataatggacgcgtcctctgataataagccctttaaatttttcatgacactattgatattccgtgagttatggagcacgtttgcacataaaatcacatcaaagctgaatgcctcatacccttgcgatacgaagtcttcattaatattgaaaatcccgtatttcacccaattatacttaccgaaattttcctgtgccttatttaagaagaaaaccgaaagatcagtaaaataatactcaacattacagccttcaagctcgggtatcacatcgagagaggttccaccaactccagctcccacctctaatattctaaagggtttctccggactttttttattctttttctcgcacagataacgtatttctttcgtagcaatgttgttgagcatcccatttactttattgtcatgataagctgccagcgccgggtctgtgtctccctttggaaacagaatattcagagggtcctcttttccctgaatcagttctggaagcaaatcactcgattccttcaaataatcaacaaactccttgctgtattggaaatcgtcctctatttcaaaaaattccttccaaagcttttcagaacctaaatccgtacttatctcagaagctttatatgcattggcttcacatgtgataattccttcattaaccaatacctgcagccatctttttgtcaatttgtgcagtttctccggtatcgacatcatttctacaatttgctcaaaattgaaggctttggatttatccgaaaaaattccgcgctttctaaacgtgttgtatatgtccgcagaaacaacttcctctgacttcttaatccacttttcaagtaaatcctgatccatctgctcttcataatattgttttatggacttgagcaaatattcctctttatcgtccagagccggtgatgccacagtctttttcctgaccggagaaatgactgcatcaatatgcaaatcctccgggctttcacctaacgctaaagcgacagccctttcaatcagtggatgttcatttaagacagaactaatttcagccagttcaactctatggccgtgtattttaacctgattatcgccgtcctcgcgtcctttaaaaataatgactccgtctggtaaatagcaccccttatccccggttctgtaaatgcgctctccactccacggaagagcagggtacttttcacgattcagctgttcatccttcaggtagccggaggataatccgattcctccaatgtacaggcttccgtctaccccattagggcagggctgcatttcgttgtttagaacataaaatgtttgattggacattggatatccatatggaatgctttttgtaaatactgcttttttagaaatatcgtaactgattgaccagattgctgcttccgtggctccaccaaggctgatcacacggcaatcgccaaacagatcgtaaatcctatgcggcagggttacgggaatccagtcaccagaaagtaataacagcctcacctgataatccacgctgacatttgcggattcaagataggaaacaatcatctgatgcaaagcaggaaccgcatttattacagaaaccctatgtctgattattaattccgacaaatatttggaatccctaattttatctgtactgggtaatactaatgttcctcctgctgaaaaacagccaaataaatcatatacagaaaggtcaaatgataaatttgacaaccccaggaatacatccctctcaccaactgcatatgtttcattaacatccgcaattgtatttgatgttgcacgatgagtcatgataacccctttgggttcaccggttgttccagatgtaaatataatataagccggcctgtcataatctattttatcaataggcaacgattctgtcggttccggttttaggctgtgaatatctacaacattgcagtattgttctaaatcctcattccctgcttctgcaaaaagcagtttaatatctgcacttcttataattttctctttgcgtttatcaggctgctgcacatctattggcacataagtcgctcctgaaataagggcagccagtaccgcagctacctgccatacatgtttttttgtatcaattcctatcttatcgccgtcctgggttcctgcctcgcccaaaatacgcagtacagcattcacatatcccccaagtgaacgatatgtatattctccctcatcagttattaatgccgttttatcagggtaaaggttaaaagatttcaggaatccatcttcaagcattgccggcataatatttttaaaagtattatttacatcacgtcttatttcaagggtttccttcataaggctgaccgggtatttttccttaagaacttcactatttttatcggctatagattgaagcaacaaagcaaaacttccaaacatttcttctattatatagccctcaaatacaccatttcgcacgtcccagttaatagtggcaccaccgttttcttctgcggcctggcagtctatatacacctgcggagtctgactcagtttatatacaattctgttttttacagttgtatcatcctttgaactaacccccaaagtacttgtgaacacaaccggcataattacatttttcttgcgttctttcgttagacgtcttattatttctactccggacacatctttatgttctaaatcagaccagagatccatttgcagttttttcactctttccagaaatgtttcactatactctatatcaatggcagtaatattgacatctgtgaaatcaccaaccactttatatatatcttcagccacttccggtctgttgagcagtgtagtgttaatacagaactttttgtcaccagaccaaactgctattacctccgccagtgctgccataacaaacacagatggcgtaatattatacgattttgccaattcaacaaaagctttccattgtttatcattcaagaacactttcttctgaaggaagctcacttcctgattgtcctccatccctataaccggaaggttaggtgcatctcccatcattgatattttcttattccaataaacttccgcttcctgccttgatttgctattaaatgttttccgcttctcctgatataaaacaatatctctgtaagacgtagtcggtataatgatttcatgaggattctcataaaacctttcaagatcattaagcattacattcatacttgcaaagtcagaaataagcatgtctaacgaaaaatagattatgcttttgtctttctcaatactcaaggccaaatcacacatgggccacgttccaagctgatactgcttcgtagataactcagttctcagttcttccttatcagcgctaatatctttatcccgcccgtcaagtactatgatttccactgaaggtactgcctcctggacaatctgataaccggatgccgatacaattgcccgcagcatatcatgcttttgtatcactttattccatgcaacctccagctgaccaggatcaagtaatctattgacttcaatttctatgtaaccgtggcaaccaattccacccaattcatataaacgatttcttcccataacataggaattttgtatgtcggtcagtgggaatttttcatatctccgttttgtatcactggtgaacactaagttattatgtgcttttaaataatccagcacttctgacttatactgtctcaacttatttttattttcctctgtcattgcccccttcggagctttgaacttgatggaatcaccttcacaccaaattacaatttctttttctgccagctcattaatgtacttttggatatccataattttttctccttgtctgcagctaaatggtatcaatcgtcaactctgcaccctgattaatcatttgtatctgacttgccagttctctaatcgtaggggcattcactaatattgctgtcccgagatctccattgactaaatgtgactttttaattttatcaatcagcataatcgcctttaagctatcgcctccggctttaaaaaagctgatatctcttgaatactttgtggaaccgagtacttctatccatagccgttctaattcttcttctatagctccctgcggtttttcgtaaccggccacagcctgacgttctttaaaaaacaattctgctaccattttacggtcaactttcccatttgcactcaacggtatagactttccatattgatattcagatggaaccatatagagaggaagataggaactaatcgactgatttatggtttcgtcctgaatcaactcactatctgggtcgtttttaacaataaacgcacaaagtttttgactgccgccttccgaaacgatacatgcaacagaactcttaataccttccgccctgttgattgctgcttcaatctctcccagttcaatccggtaccctctgaattttacctgcgtatcttttcttcccaggaattcaattgttccatcattccaaaaccttcccatatcaccggttttataccatcttatgtttttaaatgatacaaacttattatttgtagtggtttcatcaccgacatagccctttgccactccaattccgccaatccataattctcccggcacccaatcagggcagtctcttcccctctggtcaacgaccctgtatagctgtccgtccaggggagttccatatggaattgatacccactctttaggaacaggcagcttcacctgataataattagaccatatagaaccttcagttgctccaccaagagctgtcaattcagaatttggagcaacatctgctaattttgccggcaggtccgtaccaatccagtccccggacaacaatacggttttaagggattgcaatttcatctcctcagcctgtgcctgttccagaagcatccgtaatagaaaaggcactgaattccaacaggttatatggtatctggtaactaaatccaaccattgagcagcatctgttttactcgcctcgtccagcaagactatagtcccgcccgttccaagaattccaaatatatcataaaccgataaatcaaattccaaagaagacactgccaataaactatctttttcactgatgtcacatttcttgttcacatcacaaattgtattcatggctgaaaaatgggaaatctccacgcctttgggttctccagtagttccagaggtgaaaataacataagcactgctggaaggatttactggttcattggcagatatctcctcccgcttcgcccggtcattcacatcaatgatattcactctgtttaaccttaaatgacagccatgagataccatatatcttatatcagcgcgtttcacgatcttttcgatgcgcttatccggctggttcattccaatcggcacataacatgcacccagcagcaatattgatagtactgatattatctgttctgctcccctgggcaatcgcacagccaccttatcgccaggccctacaccttccagctgtaataaacgtgctaatttcttcgcttctttgcacagctcataataagtcaaggttctgccggtgccttctatgacagccgttttgctgctacggtctgttgcatttctaaaaacaagttcatgcagacatagattctgctttaccccaattgtatttatgcctgaatatctctctgcgaattttgtctctgatattacaggaagttcttccccccatttgtcaggattggatatagtccatctcaaacattctatataggcactgaacatatcctctataaagcctttcgggaatacatcttcaactgtgtcccacgaaagcaaaatgccttccgggaatctcatgacctggaaatctatcaaaacttgcggtgtctgtgaagaaatatattttaatttgccaaaactccctgcaaacccatcagtaatgattggttccatgcagtcacaagaaaatacgattggcgccacaagcttttgtgttggccttgaccttagtatatctcttattactttcactccggaataagcagaatagtccagcgattccagaaaggcttcctgaattcttttcgttttactaataaaacctcgttcttcaatgccctttaccggaagcaaaaggatatttgtaaaatcagccactttgtcctctgcttctgacggtctgttaaacagaggtatattcatcagaaaatccgattgattgctgtaacgttctaatatctgtgtataaatggtcagcagtatcattgcaggtgtgacctggttcttcgcagcacttgccgcaagcctgtcccaatccgctttctccagcataaaatttcttcttttaaacaccggcttctttaccgattgatacgctctctttaatggcagttccggcgcttccggcagtgtagcaaagtgttctttccaataagcggccacttttcggtaagcgtcctcattttctttatgcttcatgtgctcttcaagagaaaaaggcgattgcgttttctcaaaagaacaatcattatataatttttctaaatccgaaaaaataatctttatgctctttaaatccgctaccagcaaatcaatgccaaaatgcaagatagttttgttcttgcctataaccgataaaatgagtactgccacttcgcctcgttcaacagccaacactttatgactgtactcatttcttaccgcttccattttctctttcttttctgtttcatctaattgttgtaagtcatatattatgatgctggaattatatggtttatcctgaataacctaggttccgctctccaaaaactttgtccggagcgatgagtgcaggtattgcacgttttcccacgcctttgataacctctgccggtctatttccccacattcaaactcaaaatacagatagcacgatattcctcccatcacctgatctggatttctgcccacccaatacgcatgctgaacatcggtaagaggaaattccatcgtttccgtccgactcctatccacttcctttttactttctgcgctgacactctgcatttttattattttccaccattccgccagatacggttttttcagcaattcagaaacgcggacattgatacctctgcgttttagctcactggatattagcattacctttaaggattcaaatccagcctcaatcaaatttatgttttctatatctgcagtataagaatactccccaatctctgctataatctgacacagctctgcatatgtaatctccgatttcatattttctccttccctgcagtgttattcgcaatctcccgcagctttacccggttaatcttttttaccgatgtaagaggccactcatctatcttcacaagctggtctggtagcttatatgttgccaaccccttttccataagaaattttcgtatatgtgataaattaattttttcatccgcagtcatgatgaaagcacaaattctttctcccattagaaaatcctcaacacctactaccaccgcctcatcaatgttcggatgttcacttataaatatttcaatctctctcggttctattttctcaccagacctatttatttggtccgtgatccttccctgtacctgatatccatatgtggaatcccatctcactttatcgcctgttctataaaatccgtccgatgtgaacttatctttcatactgacatcctggttataataactttgaatggtaaatggtccacgaattatcaattctccttcttcaccattcagtacgtccatgccattctcatcaataatccggatttcctcatagccagacaccgaataatggtagcctaccgcatcgccaagattgctgcgatcataaatactatacagggccagtccttccgttgctccataaaggggtaagacctcacattccaccttttcaattaattttgtaacaaggctctcatcaaccaaggaacctccaataatgattttcctgacgctgctcaaatcatatccacactcttgattcagatactgattccagattcgcgccagtgttggaactaaggctgtaattgtaatattttctttttcaacttgtacaaaaatatcatcgcagtccaggtcactgcataaaacagcttttccccctgcgaaaaacacattcagaattccgggcgaatataacccaaccttatgtgctaatggcagacaagctaaataactgtcagaggacgtaaactggaatttctgattatatccataaatatgccaataaatcattctatgagtgattggcactaatttaggaactccggttgttccgcttgacaacataaggagggctatgctgtcaagctccttgttttcttcgatgatattttcggtgtcttctttcaatccttcggctatatccttgactgcgattttacaaatctgtctgcttgcacgccccttgtgaatccttaatgatacttcgtccttatcatagaaaaccaatgttgaggcatccgtcttatcaaaaatgccctttaactcattctcaccaaataaagagtttgtaacaattgggattgaacctattttaattaaccccagcaaaccaaatacaaactcttttacattcggtattcgcaaaacaaccagttcacccttgcttatcccgcgccttttgaaatagcagccatactggttgattttcttttccagttctccataggtaatacgatttatgccctccacaatagcggtcttatttctatttgctttaaacctttctcccagccagatatctatcgttttctcctgtaccggtcgcaatttcttcccatagttcattctcattcctcattccatatgccaaacatgctttatgacatttatctacagcaatttgacaaatccgccaaatctgatctccgtagctttcactgctggttccgccgatttttacagaaaaagaggcgaaatctttataaagcccatagccgattgccttcacataggcttctttcgctgtccaagattcaaaaaaggactcaatattattttgcctgattacagttgctgtttcttctggtgaaaaataattttctgcgagcctttgatattcctgtatttgttttattgcctgcacatctacgccaacctgaacattacgtccaaaggcaagcattacaatctctcccgagtgagataggttgtaatttatagatagacgttttccagaacagcacagatatggtttcccaaaacgtcctctctcaatttgtatatcttttatatctttgccaagataagatgaagaaatcttttttacagcgattcgccctattgcacctctcattatgtcttcatactttacatatgatgtatattgctttatctcttcttcattcaagattccccaattctcttttatccaacctgtcatgcttctccaccgcagaatccaaacctgtatttcttctggaggaagattattcataaagcaatgccgtgaagtgaatgtaggacgaatcactttaattttcacgattgataaactcctcagatttttgatgaattaactttaatacattttcctcatcttcttttataaagaaatgcccgcctctgaaaaggtaatactgaaacttgctctgcgtgtattcagaccatctcttaatatcggccagggtcgcttccctatcctcattcccgccaattgccaaaactggacatattaattttgatggggcatccggataatagctttcatccagaataaaatccgatctgattatcggcatataaaagttcaacagtcttttatccatttttatttcttccggaataccgtcatatcgttccaggccaatcaaaaactcctgttctgtcaaatgagatatcggctgtggttccggaatatggggaactctgcttccggagaaaatcgccaactttgctacccttttgttgttctcaagcattttttcaacttcaaatgctattttgccgcccatgctatggccaaataggataaagtcattgtcaagcctcataatagcgtccacaacgtcttttacaagtgattgcatgttcaaatatggcttctcaccaatacgttcttctcttcccggtaattgtatggggcaaaccgaaagtttcttgtcaaaatattgaatccacttagcatagaaagcggcaccgcctcctgcatatgggaaacaaaacattattgtactttgggggctaataccttccgaattcttaatcaatttcccattgtatatcataacctcacctcctgaatccagactaacccaaccgccccccactgatttaaaccctgcagcaaacaacagcaatgatggtactggacattactaagaaaatatcttttgcagtcagacttataatgtaatagctatctttcttatacggactctcgattcctctgacaatggctgatgatgccagttcgtccgctattttcaggcttctgaaaaccatagggacaattgcatattccaatgtactaagcgggtgaaaaaggactgtccttatagaccgcaaaaagcctcttaccttcatagcgtcttttacttcaccaaactcatgaacaagggtgggagcaaaccggagcatgacaattataatcagcattatattttcgggaatcggtaacttccttatactggaagtcagtttgcctgaaggtatatgcactatcagacacacaatcatcgccggcatcaatagacgataaagcatatgaaataacagcggtgatggaaaagagatatggtattttgtattaatagccagccaaactaccgacaggatatatacccccaacattcctaatcccatcgtaaataactcaaaatagcataacaatagaaaaagccatatcatatataaaccatgccccagcaaactggtgcttaagaaggaagtgaagcatgcgcagacagccaacagcaacactgtcctgccatcgatctgctccacttttctgatgttactatgattcataatcattccaaaataccagctttctgaaaatgtcttcttaatagtctctgcccgaacagaacacctaatacagcaagaagaccggttattgcacagcccaaaagcatcagccccggatgggttgacattaaaaactgcatatctaaggtttcctgtgaaaagccactatttaatgccatttctttataactgtcccatgcccaccagagaggcaccgcacatccaacgaaattcccgatactgtttaaagcccagccaatcatattgcggatcggctttctatatgtattttttccaatcatagacagctcggaaataacgcctacaatcaggaaatatggcagcaagaaggcgtaacccataagtgcctggataaggccatacacaaatgcccaaacaaacaacagcccatgtttgttcacccggtttgccgctacaaggaagaatacagctcctaaaaagccgtcaatggcggctgaaccatataaatacacttctgaaaatggcaatgtgacagcgctgaccaccattgctatcatataattgattaccaacatggctgcaaccgtgattacgtctctgatactaaacttacttccctttgtttcactcatataaagatcctcctgtaatatagtggttttggttagttgctactaactattagttaaagcctcggcatgttagcagcaactaactctattgtattttacaggattctttttaatatttctacccctttaaatgtgtatttttttaaaatagcccattttaacagtttgtttcattcaaaggcttgtcacatcacagggctgtagatgactttatgaaacattcaattaaatttcgttttacttaaatattaaattataaaataattgccgcagactttttgataaatcgacattgtcactattataaaaagtactgcggcctgaatcattatattaacttccagcttactcttacgtatttctatatccgaaataagttctctttagtccttatgacaaataacatttctctcagcccacttcaaagtactctttcgctttcatatagccattgctgaatcacccttttcgtgggagaaaaattcctgtaaaagtcttacagcctcgttatccataggccgatgccataatatacggccatgctcaataaacataagatgtgtacagcatttgtatatcagttcaggatcatgcgttatcagaaacaacgtttttttcatttcttttagctgtattaatttttctgaaacctcaagcatatgtctataatccaatccactggtgggttcatcaaatatgattatttctttcccagatgcaacagcactgccaatagcgactcgctgcttttcaccaccggataacgacattgggtgcagtttcagtttatccgacaaatcaagcccggccaaaatttcttgtgcccgaaccttgtcctcttcctcattttctccatccatactcagcaaaagttcatcaagtacatcttctgtaaaaagctggtgatttacatcctgcattaccatataggaaatatgccggcgcttcttcgcattgagagcattgccatttaatttcaaagtgccctttgaagatttatctaatccgcatagacatctggcaaaagaggatttaccagctccattgtcaccaatgattccaatgatttctccctgcggcaatgttaaattcggtatgtttacaatcggatatccccgtttttcatatgaaaaccaaaagttatcaatctgcaggcttttttcatttgcttcaggttttttttcaggcatcaagtcaaatggatttaatgcacgtaatcccattttctttaactcctttggatctagttccaaaaattcctctcttgtatattcattacatatctctccgcgcttcatatatatgattcggtccgcatatggagccaggtaataaaggcggtgttcggcaacgattactgtcttattttcagattgccattggcgaattacttctgttaaatcttttatcgaagaaatatccaaatttgaggacggttcatccaaaacaaaagtattagggcagatagcatctgccgatgcacaggctatcttctgcttttctccaccagataaagcaaacaggctccgtccaagcagattttctaatttaaggcattttgttgtattctcaagccttgccagcatttcctgcaccggcaaccccaaattttcgcatccaaacacaatctcgcttgtcgtatctacattgtagaactgtgttctcgggttttgaaatacagagccaaccatgggggcaatctgatataactgataatcctttacctctttcccatccaaataaatctgtcccgttaactgtccattataataatgcggaatcaatccgttaatcaggcgcgtcaaagttgttttaccgcaaccagattcaccacatagtaaaacagtctctccatcttcgattttcaaattgatattacgcaggctattctctgattctccgctttcataggtaaaggacacatctttaatttctatcatttcacttccccttctaccatttaataataaataaggtgacaaacagcataacgcctgaaattactaccgcaatggcatcgtaacaggtaaatccaactctcgttatgcttgaccgctttgctggattatccagcccacgggtcaacgctgccgcagacagttcatcaccaatctttacaaccgaaatcataagcggtatgaaacgatattcaagcagtgccattggattctgccaaaattttttcgtaccaaactggatttccctcattctcatagcgtctttaatagctgctgattcttcctgcatggtaggcaaaaagcgaaataatacagaaagaggaatggtaatattcctaccgatatgcattctgctcagtgatgtaatacactcactggcagtagtagatttaattatgtaattccccattgcaaaagcaggaaaaagccttaaaaccaatcccaccaataaaactacaatcatattgacaaccatgtgaaaacgaattgagttttggatttccttaaccaccaaagcagctacaaacagaactataaaaatggccgctgccttatattgtctgtttgtaagtaatagaataaaaggtatcaaagccactgcaagcataaaagcggtatggccatataaaaactcggcggtagctacaacggccatcagcagtaattttgtccgtgggtctaaatggaatcctttcgtctctgtaacagcaagcatgtgcatcaaacaatacccgccctctcaaagtgcttctttaacattttatgaccgagcaaagcaccgcaaatcccgccgacaaacaaaatcacaaatcccgcatacatcatccatgatggcatcatagattgtaatgtttctgcgtattggttccccatggagctgtgaatattttcccagtaggactgcccggcaatccaaagattcgcagggcatcccatcatgccaaggcaaaaacacgcatagcttaggagggtaacgttaaagtttttatactgaccggcctttaacacaatatcagcaagaattccgcccagtgtccaccccaccagcccaatccatgtatagcctataagaaagaaaaacagaccgcagatgacacctgtaattgtcagcatcccgaatttctgaatttttgtgtagtacagcatcataggaatgccacatacaaacggccagataaacagaaggaatggatatattacaggcagtgcagtcagtaatccgaaaacaaaaaatattacaagagtcatggcagtataaattcctacattgataagatcttttccatttagtttattagatttttgcattttaatcgtcctttcgttatgactaatttcatattttatagttagattcagctaactgtaggggaaattttttggggattaaatccccaaaacagtttgccagcccgagctgaaaaataccgatagcgtatgagcatacttcaatgcagctgactttggataattgtgcataacaatttccgcaattgaagcatagtaagaatggaccaacatatgccactcgtcctcatctaaatcattgacaggtacaccgcgtgcttttaattctgcaatgagttttattgtctcctgcacatctgcgcgtaccaagtcgtctaaaaagcctgcatactttgttcctgacgagcacatcagaagcagcctgaatacatcaaaatgctcataaatatattcgattatctggataatcgtactttctgacagcctccacaaattcttaagctcatctgtttttactaaatcaaaatgcttatctattgattctgaatatatcttttggattgtctgaacaactgattccactaaagaaccaaataaagcttccttatcagcaaaatgattgtaaaaggcaccattggttacatttgcgtctttacagatttccctaatactggctctttcaaagccaaattctaagaagtgtttctttgcacaggccaaaagattttcatgagtttgctggaaatcccttgacatttcctcccctccattctatactatattacactgtaatattacaccgtaatatagattttaccacccttttcctaaaaaatcaatacccaattacaaattctgattagcagaaaggaagatgtttatatgaaatcaaaagaaccgggggcaatccggcagctttttatgtttgttggcagtagcaaggggaaaatgaaattttccattcttatggccgttttaggggaactatttggtatggttccattccttatactggctatgttggcagactcactctattccggaacagctactactaaagatacggtgatactggcgggaatcgcggcactttgccagtgcattaagacattccttacatggaggtcgtcccttctgtcccaccgtatttcctttactattttacaaaatatacgtgaaagaattgccgataaaatggcgaaggttcccatgggcgtcatgttggaaaccccttccggcatttttaaaaacttaattgtagataatgtggcaaagctagaggattctatggcccattttatgcctgaacttccgtcacacatcacagcacctctatgcagtattctattaatctttattttggattggcgcatggggctggcctctttaattactgtcccgttgggaggtttgtttttcgctgccatgatgcgcggatatgcctcccgtatggaaaactatatgtgttctgcgaatgaaatgaacagttctcttgtggaatatgtaaatggtattcaggtcattaaagcttttaaccggtccagctcgtcctatgggcaatactcaaaagctgtcaattacttccacgactgcaccatggaatggtggagtgagtgctggctatggaatgcggccgctcgtgcagtccttccctccaccttacttggcacacttcctatcggcgctttgctttttatgaatggttcgattactttaccggttctgatgatatgtcttattgtcccccttggctttacagggccgctgatgaaagtatcggaagccatggagcaggtaagtatgatcaaaggaaaccttgaacaagttactgccttcttaaaaactcctgaactgcagcggcctgcggacccggttactctcacagaaccgacatttgaatttagtcacgtttgctttggttataacaaaagtgaagtgctgcacgatatctcatttaagacgtcaccgaaatcaatgacagcgattgtcggtccgtccggatctggtaaatctaccatagccaaattaatggcgggattttgggatgccacctccgggactgtgctttttggttcacaggatattcgcaacatcccctttgagcagctgatgggagaaatcagttatgttgcacaggataactttctttttgataaaaccatccgtgataatatccgcatgggaaatccagccgcaacggacgaacaaatagaaaccgttgcaaaagctgcaaactgccatgattttatcatgcaattagaaaaaggctacgacactatggccggagatgccggagaccgcctatctggtggagaacgccaacgtatcaccatagcgcgtgccatgcttaaaaaagcttccgtggttattcttgatgaagcaactgcctatgcagacccggaaaatgaagcactgatacaagaagcaatcagtaagttaatttccgggaaaaccctaattgttgttgcacatcgtctgaatacaatccgcaatgccgatcaaatccttgttgtagctgatgggaaaatagctggatgcggaacgcaaaatgaactgttagagaactgccctctttataagaaaatgtgggagaattattcagatgcggtaacttccaaaacgaaaggagaatcttagatgtttgaaatgatttctcgtatttatcaaatcgccggctccagcagaaaaaaaataacagttggaatactgtgcaatattttaaaatccttttttcaaagttttatgatgctcagtgtatttttaatcatgttaaatcttgatacactaacctcctcaataattttaaaagctgtaactatcattcttattagtattcttggacgtttctttttccaatggatgagtgaccgtaccatgagcggaaccggttatgatattttccgtgattaccgtttagaaattggtgagcgattaaaacaagcacctatgggttatttttcagagcagaaccttggaaccatccaaacaattttaaccactaccatagcggatctggaaggttactccatgatggctatcgaacagatgaccagtggtgttgccatggcattccttatgtctttcatgatgttctttttcaacccaataatagggacactaagtatgataggcttagtaattggcctgacagtattacgcctggtcagacagcgggccgcagaacattcgccaatttatcaggctgcccaggaaaatctggttaataaatgtttagagtacatacgtgggattgctgttctccgttcattttcaaacggcaaaagcggccagcaagaggtacacactgcatttcaaaagaaatgggacgctgattattcacaggaaaaggcaaccgcaggtgttctccggctatatggccttgtctataaattgatgagctgcgtcttaatcgctgctgctggtatcttatacatggacggaaaaatttccctaccattctgtatgacatttttgttttgtgcatttaccgtttattctgatttggaaactatgggaaacagtgcattcttgagtaagaaaataaataccgaattagaccgtttggaagaagtgacaaatattccccagatggacaccaccacagataaactccatccttccaattatgagatttcattaaaagatgtatcatttggctatggttcccgcagaattattgaccacatatccttaaacataccagagcatactacatgtgcgattgtaggtccgtcaggaagcggtaaaacgacattatgtaacttaatcgctcgtttctgggacgttcaggaaggctctgtgtgtattggcggccaaaatgtgaaagactataccgctgacagtgtgcttgactgtatcagtatggttttccaaaaggtttatctattccatgacacaatcgaaaataatattaagtttgggaagcctgatgcgtcacttgaagaagtaatggaggcagcaaaaagagcctgctgtcatgactttattatggccttgccggatggatatcaaactgtaattggcgaaagtggatctacattatctggcggcgaaaaacaaagaatctccattgcacgggcaattttaaaagacgcacccattgtcattttagatgaagcaacctccagtgttgaccctgaaaatgaacaggctcttttatctgcgattgaggagctgactaaaaataaaactttaatttccatagcccatcgattgagtaccgtacaaaaagctgaccagattattgtgattgataatgggcacgtcaaacaaaagggcacccatgaccagctcagtaaaaaggacggaatttaccggaatttccttaaattacgtgtggaagccaccggatggcaattataaatattaccccatttcacccctctgtatcaatgaaaaccagggaaggatttaatgaattccttccctgattttctttttgtgccaaggcactcattttctcttaaccttccagaaccgggcagtcgtcaggccatatacctcacctttcgcttttgcatagacctgtttttactaaacaattgcctgaacctacacattcctctttaatttatttttcctatctaatcaaagtatttgcagttgccagtttttcctcccttaacataagttctttccatacatctacaaagccttccaaattgtttttcgacagctttttcaccatctgattgatatagtccagatattctacatgcatacagcttttattaatgcggatcaatgtgaatggatatccccaggccagtaattcatgtagctttttatagcattcctgtactacttctaagtcacagttttcatcaacatagttcagaaagaaaaaaaccgataaccatgagaaatatgctcataagttatcggttctatgttttcaggtgtttattcagtaatatttagtccacaaatacagtttcattcacccgtttattcaatgcatcaaattgctcctttgatattattggctcataattgcctatatatctcaactcttctgaatatgattttgttctcgccgtaacaacccctgcatagtatacggaggcaggcatttttctcaatctctttgcccatatgcctgcacttctcattagattcccctgattactccaatgtgattccacttctgtaaatgacagctccatcacattctgtaaagcaagcaatgatatatcttctcccgcctgaaagtattgttcccgaagttctatttcttttcccacctgccggcaaatccaactatagggaatactgtttgccgcctcctcgtaattcaagacaagatgctgtgtatcttttttataatctatgaactccaataccatgtattccggcggattgttcagataatccataacaaactttaaagcagacctcacgcgaaaagcttccatttcctctacaactaactgcctgtccttaatacgataaccatagggtgcctttacgaactcggccctctttttcatacgacttttcatacaatccttaatattcttcatatagattgtccactccttttaatttgaaagtaattaacttgcttttctcatacacagcatattaatttcgtcctgaaatttaaaaacaacttcaatattatgattcttgtctaccaacactttttcaataaaggcatcagccaactccggagacaacgcctcctcatttctaaactcatcgaccaatcgggcaaaatctgaatagaatatgatatttgcctcatcatattttcggattccttcttccaccttttgaattcctgcctccaatggaacaagctgttctgacaatttctgtttttttatcagatattcttctctgcttacatgccctgctctgtaatcttcatacaagttcattttcttctgctttatttcttctgccctctcctgaaatctttccatgattgcatggtaatctgccatattatgattcaaagcctttaagattttctttttgctgtcagtaaataatcttaaattgaattgtataaccgaaaacactgctttttctaataccgctgtttcaataggcggaaaagtacaatccgacaatggattttcacgcttagccaaacaatagtaaaagtcattatcttcatgatatctgcgcctgcttaatgctgaaccgcaatgtacacaatacacatttttatataatgctgatactctgcgcctcggtccacttttgcaaccacttttagcagccctctcatccagccactcattcaccctgttaaactgctcttctctgataattttcggctgtctgtttggaacaagaatttggtccgccttattcactgcccgtgttccttttgtccccaatacacaagcctcttccttatgacgtactgaatatcccaaataagctttattccttgcaatctttttcagtgttgttttattccagatagaactggtcttacataatttggcattgtattttttagccaaataaacgctcggcggatcaattcctttttcagccaggaacttaattataaacttataactttttttctggtctaatagatccataattatttgtagtacatatgccgcctcccaatccacctcatattcacggtcagctgtataccgatatccataaagaggtactgggccgttatgctttccttgaagagcctcctccatcttaattctcttctgagtggtagacgcctgaattggaactaacccattaatcaaattcttgaatttggcttcaaaatctataccatattgataatctttgctgtcataatcatcattaatcgcaatatagcgtacttccaaaaaaggaaatatcttttctaaataattgacggtatctatggtgtccctgccaagtctggagaaatccttcgttgctattactatcatatttccatataaagaacggactctgctcatcatattctgaaaattaggtcggttaaaattactgccagtgtagccatcatcaataaattcttctacttgataatcatgaaattcactgtgttcctccttgaatcggttaagcaatcttctttggtttgtaatgctgcagctttcatcgtctccatcttccctggaaagacgttcataaaaaagcagaaattttttcttcatcctcacaccgcctttgcaatcaaatccatgctgaatatatcttcaaatttgaagataacttccatggaggttttgtctataattttgatttccgaaatcaattcatcaataatctccgctgtcacgcagagatttccctgcttgtccatcaatgcagaaagccatttgttctttaaagaatatctcctgaccatatcatttgactctataatcaaactcccttttagtgccctcagttcatcaaccttctccatattctgtcttttaaattctatgtactctcttttatccagaatctgatctacataatcttcgtataattgttgctgcctcactaaaaggctctggatttcccggtcaatgtcagcaatctgattctggtattcccgtttcaatttggttataaaagagtcctttttatatgcttttttctccttcattgctatactgacccacttatctaagaggaccgtaacagcttttaatactgctttttcattgataaatttgttcttgcaatgattaggtgctacatcatgtccaggacaatgatattcaatacctattccctgctttgtatgatacctgctttgtgacatatgccttccgcaaactccacatacgagcttccctgcgaataatccatatttcttatcaatttctctggtaaagctattcacccagattttctgtgcgttcttttgggccctgtcataaattgcctgctttatgatacggggtagagcatcctcttcaatattccattcctgccgcggcaccctttttaatttttttcctttataatagctttgttctgttttatgggtaaccaaacagccaatataaacggggttctgaatgatactagaaatgaaattgcccagccacagatacttttccgggttcttttctaccttttctgcttttccatgttttatcaagtgataggctttcggcgagggaatattctccctattcaatatttgggcaatcttatagtatgaatatccttccagcacaaacatgttaaatatacggacaacaacagaggcagcttccgggtcaatcacgagtattttactattggcttttgaacgctcaaatccatatggcggcctcgctccccagaactccccattgcctctggccagttcatgggcctgggtaagttttttggaagagatacgggcgtaatattcatttgccagatgtttaatcacataaaccattcgttctttgctgcattgtggatctgcactgtcatatccatcgtctatgctgatgaaacgaacatctaattccgggaatactacatctaacagctccagcgcttccaaatagtttcttccaaatctgctaaaatccttaacgattactgcattgatttttccagacttaatatctttgagcagttcagaaaagcccggacgattaaaagctgacgttagataacgatacttttgaaaacactggaaaatcaaggtttttcgagcgacggacaagcagggtattgtactaaaaactgaatacgacgcagaagcggcgtttcttactctctacatgggagaacaggaacgccgcttttttatgccctttgttacgcagtaggggcagaaaaagccttgctacaagcgattttgcgggcgcgtatctggcgcggcaagggatttataccttatcccccgaaaccgcgcttctactgcgtaacaaatccacagcaaaaggagtgatttactatggcagttttcagagtggaacggaacaagggctacaccgtaatgagcaaccaccacctacgcaacaaggagctttccttaaaggcaaaagggctgttgtcgcaaatgctgtcactccccgaagattgggactacaccttgaaaggcttatcccttatcaaccgggagaagatagacgctatccgcgaagccattaaggagcttgaacgcgccgggtatatcgttcggtcaagggagcgcgacgagaaaggacgcttgcggggcgcggactatgtgatattcgagcagccgcagccgcctacgccggatttacctacattggaaaatccaacattggataatccaacgcaggaaaaaccaacattggaaaaacctacgttggaaaatccaacgcaattaaataaagatatacaaagaactgacttaccaaaaaaagaaaaatcaaatacagatttatcaagtacccattccattcctatcctttcccctaacccctctccttgcagagaagcggctacgccgccggaacggaaaggaacggaagcggcagcacagagcgcagttgatatataccgggaaatcatcaaggacaatatcgactaccacattctcaaacaggacatgaagtttgacggggacaggctggacgagattgtagacctcatgcttgaaaccgtatgcaccgccagaaagcgggtacggattgcgggggacgactacccggcagagcttgtgaaatctaagtttatgaaactggacggcgagcatatccgctttgtgcttgactgtatgcgggagaacacaacgaaaatccgcaacatcaagcaatatctgaaagcagcccttttcaacgccccgtccactatcggcaattattacacttcccttgtcgcccatgacatggcaagcggcgcactgtcaccgaagaagccgcagtacggcgacccggactattattcattcaaaccgggcgaaagcctgtaaaacaacaaaaggaggattttattatggcacagaaaatgacaggagcattggtatttgacgagcgcaccgaccgttacgacattcgctttgacttaaacagctactacgggggcttgcattgcggtgagtgctttgacgtattcgtgcggggcaagtggaagccgacccggattgagtacggcgacaactggtatcttgtgggtatcagagccgaggacttgaacgggctgcgggtgcgtatctgaccgccgccccataaagaaacgcgaaaggaggacgcgaggaattgcaggacgaagtaaacgaaaagaccatagccctttacatcaagaccgggaagctgaccgcccagacgctccaaaaggcaatgaaagccatactgtcaaagggcaaaaagcagcttgcaaaaccgccacagggaaagcagagcttaaagcagcttatgaagcagaacgcgggcgtttccaacattgagattaccgagggcaatatcaaagcctttgagagtacggcgaaaaagtacggtatcgactttgcgctgaaaaaggacgcaacggaaagcccgccccgctatctggtttttttcaaggggcgggacgcggacgtgctgaccgcagcctttaaggagttttccgcaaagaagctgacacaggagaaaaagccctctatccgaaagctgctctctacgctcaaagaagccgcacagggcaagaacgcggaacgggcaaaggtcaagaacaaggacagggaggtatcgctatgaagccggaaatcaagaagctgcttatcctaaatctcccgtatctgctctttgtctggctctttgataaagtgggcgcggctgtccgtctatcccccggcgcggacgcaagcgcaaagctgctacatcttggggacggttttaccaccgccttttccagtatcgcgccgagcttccacccggcagacttacttatcggcattgcgggggcggtcattgtccggctgattatctacaccaaaggcaagaacgcgaagaaataccgccgcgggacagaatacggttcggcgcgttggggcggggctgacgacataaagccgtacacagacccggtatttgagaacaatatccccttaacgcagacggaacggctcaccatgaacagccgcccgaagcagccgaaatacgcaagaaacaaaaatattcttgtaatcggcggttccggcagcggcaagacccggttctttgtgaaaccgtcgctcatgcaatgtacgtcaaaggattttccaacgtcgtatatcgtcactgacccgaaaggaacactgattttggaaaccgggaaaatgttgcagcggtacaaataccgtatcaaagtgctaaatacgattaacttcaaaaaatccatgaaatacaatccctttgcctatctgcggagcgaaaaggacattttgaaattagtcaataccattatcgccaacaccaaaggcgacggggaaaaatccggcgaggatttctgggtgaaagcggaaaagctctactacaccgcactaatcggctatatctggtatgaagccccagaggacgagaagaacttcacgacgctgcttgaaatgataaatgcgtcggaagcccgcgaggacgacgaggatttccagaacccggttgacctcatgtttgaacgtctggaagaaaaagacccggaacattttgcagtcaagcagtacaaaaaatacaaactggcggcgggcaagaccgcaaaaagcatacttatctcatgcggcgcgaggttagccccattcgacattaaggagctgcgggagcttatggaaaccgacgaaatggagcttgacaccataggtgacagaaagaccgcccttttcgtgattatcagcgacaccgacgacacctttaactttgtcgtgagtattctctacacacagctattcaacctcttgtgcgacaaagcagatgatgaatacggcgggcggcttcccgtccatgtacggtgcttacttgatgaatttgcgaatatcgggcaaatccccaaatttgagaaactaatcgcaaccatacggagccgggaaatctccgcgtcaatcatcttgcagagccagtcacagctaaaggcaatctacaaggacaacgccgataccatagtcggcaactgcgacaccacgcttttcttgggcggcaaggaaaaaaccacgctcaaagaaatatcggagattttaggcaaggaaacgatagacagcttcaacacttccgaaacaagggggcgggagctttcgcatgggctgaactatcagaaattgggaaagcagcttatgacggaagatgaaatcgcagtcatggacggagggaaatgtatcttgcagctacgcggggtgcgcccgttcttttcggacaaattcgacataacgaaacacccgaaatacaagtacctatccgacgcagacccgaagaacgcctttgacatggaaaagcaccttaaacgccgccccgccattgtcaagcccgacgaggtttttgactattacgagattgacgcagcagacttacaggaggacgcagaccatgaggaaacgtagcgcagaggaaaaacaaaagcagcttgaacggtttttaatgaatgttgcggaagccgccgacgctgcattatgggagtattggcgggaaaaggaagcggaacaccgccgttttgcaacggagtatgtcacgcgccgggggcttatccctcaacagtgacagcatggcagaccgccggggagggggggacaggggaagctacacttcccctacgctgccttgcggcagctacccctttgtgaacttgcgggaagcgaacaccttgctatgcaagctattcacttcccgcaagtctgaataatacccgtccggcagcacagcgggacaccgaaaggaggaatcgaagcaatcacatatatcaatatcggctacatgatacgcgcccctactttccggcgcagcacacagcggcaggagccgcacccccctacaactgaataccgccgcgccgcagaacttacgcagcgcggggacagccgcctttaccagagggcggtttttttatgcggcggcatacgctgaccgccttttgtccgcttgccggacagccgcagacgcggcagaaaggatttatttatggcatttttcaatagcgcagtagacgttttgcagacccttgttgtagcacttggagccgggcttggtatctggggcgttatcaatctcatggagggctacggcaacgacaatccgggcgcgaagagccagggcatgaagcagcttatggcgggcggcggcgttgcccttatcggcatgacccttgtaccgctgctttccggcttgttcggttaagaagcgcgggtaaaggcttatgcagagcatacttgacgcgattaacgaatggataaaggaaatcctcataggagccataaacggtaatctgtcaactatgttcggggacgtaaacgagaaagtcggcactatcgccgcagaggtagggcagaccccgcaagggtggaacgcaaatatattctccatgatacagacccttagtgagaatgtaatcgtacccattgcggggcttgtcattacctacgtcctatgctatgagcttatcagcatggtaacggaaaagaacaatatgcacgacgttgacacttccatgttcttcaagtgggtgttcaaggcgtttgtggcagtctaccttgtgacgcacacctttgacatcactatggcggtgttcgatatggcgcagcacgttgtttccggcgcggcgggggtaatcggcggcagcacagagattgatgttgccgccgcccttgcttccatgcaggacgggcttgacgctatggaaatccccgaactgctcttacttgtcatggaaacaagccttgtgagcttgtgcatgaaaatcatgtccgtactgataaccgttatcctctacgggcgcatgatagagatttacctttactgttcggtatcgcctatcccgtttgcaacaatgacgaaccgggaatgggggcagataggaaacaactacctcaaatccctgttcgctatcggttttcaaggcttcctcattatgatatgcgtcggcatttacgcggttctggtaaacaacatgataatagcggacaatctgcacagcgcgatattctcccttgcagcctataccgttatcctctgtttctccctgttcaaatccggcgcactggcgaagtcgatattctccgcgcattagcggcgtgtcaagggcagggtggagattttcagagcgaagcggcgaaaatacgacccgaccttgacgcggataacccccatataatacgggcgggcaaagggcatagattgacctttgccttgattacccttatgggaagttacagcaacaccaaacccagagaaaggaggttttcacttggcgtatgtacccgtacccaaagacttatccaaagtcaagacaaaagtagcgttcaaccttaccaaacggcagattgtatgttttgcggcggctctcctgttcggcttgccgcttttctttctgctcaaagacagcacaggcacaagccttgcgtctatggctatgattgccgtcatgctgccctgtttcctctttgccatgtatgagaagcatggacagccccttgaagtggtggtgaagaacatcattcagacgaaattcatagcccccaaagaacgaccatacaggacagacaacttttattccgtcttagaacggcagagaaaacttgaaaaggaggtatcagcgattgcaaaaggaaacacgaagaaacagcgcggcgggaagcgcaaagcctaacccgccccgcaagctcacccgcgccgagaaaaagcagattgcggaaatcatcagacaggcaaagggcgacgggaaagcgcacaccgcgcagcagacaatcccttatatccagatgtacccggacggtatctgcaaggttacgggacggaaatactcaaagaccgtcgcctttgaagatattaactatcagcttgcacaggcagacgacaagaccgccatttttgagaactggtgcgacttcctcaactactttgacgcttccgtttcggtgcagctctctttcatcaatcaggggacgcagcgcggcgaagcggaaaaggcggtcaatatcccggcacaggaggacgctttcaattctatccgcacagaataccgggatatgctgaaaaaccagcttgcaaagggcaacaacgggcttgtcaaagcaaaatatatcacctttgccattgaagccgacagtctgggcgcggcgaaatcccgccttgcccgtatcgaaacggacgtactcaacaactttaagctcttgggcgtgtctgcccgccccatgacaggctatgaacgccttaaaatgctgcatggcattttccacccggagggcgggcagtttgcctttgatttttcatggcttgccccgtccgggctttccacaaaggactttatcgccccgtcctctttccgttttggcgaggggcggtatttccgcatggggcgcaaaatcggcgcggtttcattccttgaaatccttgcgccggaattaaacgaccgtatcttatctgacattctggacttggaaacgggcgttatcgtcaatctgcatatccacagtatcgaccagaccgaagccataaagacaatcaagcggaaaatcaccgaccttgacaaaatgaaaatcgaagaacagaaaaaagcggtacgcagcggctacgacatggatataatcccgtccgaccttgccactttcggcagcgaagcgaagaacctcttacaggacttgcagagccggaatgaaagaatgttcctcttgacgttccttgtggtgaacatggcagacacaaaaaggaaactggaaaatgacgtattcgcggcggcgggcattgcacagaagaacaactgcgccttaacccgccttgactaccaacaggaagcggggcttatgtcctctgtaccgcttggggagaaccttatccccattcaaagagggcttaccacgtcaagcaccgctatctttatcccctttatcacgcaggagctttttcagacgggcgcggctttgtattacggcttaaacgccctgtctaacaacatgatactctgcgaccgcaagcagctaaagaaccccaacggcttaatcttgggtacgccgggaagcgggaaatcctttgccgccaaacgggaaatgacaaacgctttcctcattaccgacgacgacataattatctgcgacccggaagcagagtatttttcccttgtgcagcggcttgacgggcaagtgatacggttatcgcctacgggcaagggcattgacgggaagccccagtatgtgaaccctatggatattaacctcaattacagcgaggacgacagcccccttgcgctgaaatccgactttatcctctccctctgcgagcttgtcataggcggcaaggagggcttgcagcccgtcgataagaccgtcattgaccgcgctgttaggaacgtgtaccgccctttccttgcagaccccgacccggagaaaatgcctatcttgggcgacctctacaacgagcttttgaagcagccggagccggaagcggcgcgtatcgcggcggcgttggagctttatgtttccgggagccttaacgtctttaaccacaggacgaatgtagagctttcaaaccgccttgtctgctttgacatcaagcagcttgggaagcagctcaaaaaattaggtatgctcattgtgcaggaccaggtatggaaccgcgtcaccgtcaaccgggcagaaaggaaatccacccggtattttatggacgaatttcatcttctcttgaaagaggaacagaccgccgcctattccgttgaaatctggaagcgtttcagaaaatggggcggcatacccacagcaatcacgcagaacgtcaaagatttgcttgcttcccgcgaagtggagaatatctttgaaaactctgattttgtcctcatgctcaatcaggcggcgggcgaccgggctatccttgcaaagcagctcaacatctccccgcagcagatgaagtatgtcacccacaccgaagcgggcgaggggcttatcttctacgggaacgtggtgctgccctttgtagaccgcttcccgaaagacaccgagctttaccgggtaatgacgacgaagccggaggaagtgggcgaagcatgaacgggctgaaaactgacacaatcatcaaccgggacgcgctctatgccttgcgggagcttccagaggaaagcgtacactgttgcgtcacaagcccgccctactatgcgcttagggattacgggcttgatatgcagattgggcgggaggacacgccggagcagtacattgacaggctgaccgaggttttccgcgagctgcgccgggtactgcgttctgacggtacgctctggctgaatatcgcggacacctactgcggcacaggaaataaaggctaccatgcagacccgaagaacccgaaaggcagaaacggacagcagattgcaagaaacaaccgcgtttccggctgcaaacaaaaggacttaatcggtatcccttggcttttagcctttgccctacgcgctgacgggtggtatttacggagcgacattatctggcagaaagaaaaccccatgccggagagcgtgaaagaccgccctacccgctgctatgaacatatctttctgcttacgaagtcaaagaagtatttttatgacgcagccgccatagccgagccgttagcccccacaacggcggcgcggtaccgcaccgggcgcagcgcgggacagaaatatgcggacgaagtacccggacaggggaacgtacaggggcttaaccgggcgcgaagcggcagctactacgacgaagccctcatgccgaccatgcggaacaggcgggacgtgtggcttatcaataccgttccctacaagggcgggcatttcgccgcgttcccgccaaaacttgccgaaacctgtatcaaggcgggctgtccgaaaggcggcgttgtgcttgacccctttttcggcagcggcacgacgggggcagccgcaaagcagcttgacaggcattatataggcattgagataaacgccgagtattgcgcccttgcaagggcgcggattggagggacagacacataaaacaatataaggcgcgtgaaaaagtcacgcagaaaatgacccgcgagggggctgtcgaggtaaacgccgctaccgggaaaaagaaacgtatcagcaagcggataagggacgcggactttgcaaagaccgaagccccaccgcagccggaacaggcagcgcagcccctaccgggcggcgcaacttccccgcccttaaccgacacgccgccgcttccccatgcgccgggggcagaacgggaacaggacaccgcagcagccgagcgcgtcttggaacgtatcgacggggcgcgtaccagaaaggcgagcaaaaaggcggcgaggaaagcacaggcagaagccacagcaaaagaaaaatcttcccgcttgcagtttaccgacgaggaacgggcaacgccggagcttgaaaggtatatccgaaaatcggacaaagcagccgaccgtctggacgcggcaaaggcggctatccccaaagaaaagaaacttgtacgggagcgcacctttgatgaagccaccgggaaaggcaagacccgcctacattttgaggaacaggaaaagcccataggaaagaataagccccacaataacccgctatcccgccccgcacaggaagcgggtattttcgtccacaacaagatacattccgttgaaaaggacaattccggcgttgagggggcgcacaaatccgaagaactggcagagcgcggcgcaaagtacggggcgcggaaagtcaaggagggctaccacagccacaagctcaaaccctaccgggcggcggcaaaggcagagaaagcggcgttcaaggcgaatgtggattttcagtaccataaagccctgcatgacaatccgcagattgcgggcaatcccctttcccgcttcatgcagaagcagcaaatcaagcggcagtatgcaaagtcggcaaggaaaggcggcgcaaaaacggcgcagaaagccgcagagaacacccgcaaggcggcaaaaaagaccgccgaggaaacaaaaaaggcaatcgcttttgtagggcggcacccggcgggcgtatgtatcgccgttgccgcgctactcttattcatcatggtatcggcggggctttcctcttgcggttccatgttctccggcttgatgaacggcatacttgggacttcctacacgtcggaggacagcgaccttgtggcgacggagaacaattacgccgcaaaggaaaacgagcttcagcagcagattgacaatatcgaaagcacccaccccggctatgacgaataccgctatgaccttgacagtatcgggcataacccccatgagttagcgtcctacctcaccgcccttttacagacctacaccccgcagagcgcacaggcagagctaaatcgcgtctttgccatgcagtacactttgacgctgacagaagaaacggaaatccgctaccgcacagaaacaagcacagacccggaaacaggggaaacgaccaccgaggaagtaccctacgagtaccatatcctcaacgtgaagctgacgaacaagcccatttccgagattgcggaggaacttctaacgccacagcagcttgaaatgtaccgcgtctatctggaaacaagcggaaacaaaccgctgattttcggcggcggctcccccgatatgggcgcgtccgaggatttaagcggcgtacagcttgtaaacggcacacgccccggcaacaccgccgttgtagaccttgcgaagcggcaagtcggcaacgtgggcgggcgacccttttggagctggtacggatttaacagccgcgtggaatggtgcgcctgtttcgtttcatggtgctacaatcaagccggaaagagcgagccgcgctttgccgggtgccagtcacagggcgtaccctggttccagtcacgcgggcaatggggcgcgaggggctatgagaatatcgcccccggcgacgctatctttttcgactgggacggggacgggagcgcagaccatgtggggcttgttatcggaacggacggggagcgcgtctataccgtcgagggcaattccggcgacgcctgcaagataaagagctaccccgtcaattactcctgtatcaaaggctatgggctgatgaactggaattaacatatttttgagcaaagaaaggagaaatttattgatggctatgaacaaaattgaacgtatcgacaaagagattgcaaagacccgcgagaaaatcaccgagtaccagaacagattaagggggcttgaagcgcagaaaaccgaagcggaaaacctgcaaatcgtacagcttgtgcgctccatgcgcctttccccgcatgagctttccgctatgctttccggcggcggtattccgggcatggaagccgcgccgggctaccccgcagaacccgcagaccacgacaccgaagaaatggaggacaccgagaatgaataagaaaatccttagaaccttgaccgcactctgcgccgccctcatgctgacgggcggcttttccgtcaccgcctttgcacagaccccggagggacaggacgcgaccgacgacagcggcgttgtctatgaggaacccgaaaaggaagaaccccttaccccggacgggaacgcgacccttgtagacgatttcggcggcaacaagcagcttatcacagtgacgaccaaaaacggcaattacttttatatccttatcgaccgggacgacgagggcgaggacaccgtacatttccttaatcaagtggacgaagccgaccttatggcactcatggaggacggaagcaccgaagcagccccgcccgccgtttgcagttgcaccgataaatgcgaagccggaaaggtaaatgtgagctgccctgtctgcaaggacaacatgaccgcttgcagcggcaaggaagcggagccggaaaccgagaaaccaacagagcagcccaaagagaaaggcaatacaggcgggcttgtgcttttccttgtcgtggcacttcttggcggcgggggcgcgttctattattttaagtttatgaagccaaagcagaacgtcaagggcgacaccgaccttgaagatttcgattttgacgattacgacgaggacgagggggacgggctttctgatgaagaacaggaggacgaggaagcatgacgctttttaccgaaaaccctttagaaaaaatgatggtacaaagacccaccgggcggcgtgacagtgcgccgcccgttccaaaatccccggcgtgtatgcgttgcccttataaggcgcaatccccctgtatcggctattgtctgaaacaggcacaggagaagaagcacaccgcgccggaacgctgaaaggaggattttttcatggcatttagacttgtgattgcagaaaagccgagcgtggcgcagactatcgccgccgcgcttggcattaaggggaaacaggacgggtatatcgagggcggcggctacctcatttcatggtgcgtcgggcatttggtacagcttgcggaagctgccgcctacggggagcaatataaaaaatggagttttgacagcttacccattctgccggaggaatggcagtacgccgttgacccggacaaggggaagcaattcaaaaccattaaagagcttatgcaccgcgccgacgtttccgaagtggtaaatgcgtgtgacgcggggcgcgagggtgaattgattttccgctttgtctacgaagtggcgggctgcaagaagcccatgcgccgcttgtggatttcttcaatggaggacggggcgattaaggcgggctttgcttccctcaaagacgggcgggactatggcgcgctctttgcgtccgccctctgccgcgcaaaggctgactggcttatcggcattaacgccacccggcttttctcctgcctgtatggaaagaccttgaacgtggggcgcgtccagaccccgaccttaaaaatgctcaccgaccgggacgcggctatctcccatttccagaaagaaaaatattatcatgttcgccttgatttatccggcgcggacgcggcaagcgaaaggatttcggacaaggcagaagccgacgcgctgaaaggggcttgcgaagcgggaaaggcggtatgcgtttcccttaccagagagaagaaaaccgcagccccgccaaagctctttgaccttacctctttgcagcgggaaacgaaccgcattttcggttacaccgcaaagcagacccttgaccttgcacaatccctttatgaaaagcggctccttacttatccgaggacggacagcagctttcttactgacgacatgggcggcaccgcagcggacattatcgcgctgctttgcgaaaagctcccctttatggcgggcgcggacttcacgccggagattgcaaaggtattagacagcaagaaagtatcagaccaccacgcaatcattcccactatggagcttgcaaaggctgacccggacgcgctgccggaaagcgagaagaatatccttacccttgcgggggcgcgtctgctttttgccaccgccgagccgcatatttatgaagcggttacggcggttttctcatgcgccgggacagacttcaccgcaaggggaaagaccgtacttgcggagggttggaaagagcttgaacgcagataccgggcgacgctgaaagataagcccgaagcagaggacggggaaaatgagggcgtgacgctgccggagctttccgagggacagaactttcctaaccccgccgcaaaagtaacggagcataccacaacgccgccgaagccccacagcgaagcgtcgcttctctctgctatggagcgagccgggaacggggacaccgacccggacgcggaacgccgggggcttggcactcccgccacccgcgccgccgtcattgaaaaactggtaaagggcggctttgcagagcgcaaggggaagcagcttatccccacgcagaacggagccgcccttatatcagtcttgccggatatgctcacttccccgcagcttaccgcagaatgggaaaacaatctgacgcagatagcaaagggagccgcagaccccggcgaatttctgtccggcattgaagctatggcgcgggagcttgtgcagacacacgccgcagcactggacgggaaaaaggatttgttccgggaggaaaagccctctgtcggcaaatgcccccgttgcggttcccccgtccatgaggggaagaaaaactattattgcagcaacaaagaatgtgcctttgtcatgtggaagaatgaccgctttttcgaggaacgcaagaccgctttttccgcgaagattgccgccgcgctccttaaatccggcaaagtgaatgtgaagaagctctattccccgaaaacaggcaagacctatgacggaactatcgttctggctgacactggcgggaaatacgtcaactaccgtatcgaagtacagaagaactaaaaacttgaatagcaagcataggaagcgggtacccacttccgtaaatccctgtcctgccgctgacgcgccggacggggattttgcttgttgggaagtttcccaaaccctctaaaaaaatgaaaaaattgttggcataacgcacagcccaccgtagtacggggcgaaccccaaaagcgcggcggtgcgccgccatttcagaaaggagcgaatgaatggaaaagaaaaaaggttactccatgtttgagcgtgacaagttagacccggctgacagtatgcggatagagcgaaatatttattttgaggaacagaccgctgacctttccgggcttaccgccctgcccttagaacagttacaggcattgcgggaagaatacgcggcggctgaacaggcagcttttgaagccttgcaagaacaggcggcggcatgggacgaacaggcgggaaagacccttgccattgacaaagccattgagtatgtgaggacacccgaagctacgcataccgcgaaccagtgggaagctacggactacgggaagcacatcagcaaccgcgtctaccaaatgcgctaccacatatccgagaatacccggtatgacagggaaaaagagaaatccattccctattcgtggacgctttcatggagtatttacaccaacagcccccacaattacggacaggcaaaaatcgccggacaggaaaggaaagtctttgcagacaaggcagctatggaaaaatatctgaatgggcgtatcaaagcctatcagcatttattcaccgaggtatcgccgcctatcccgccagagtatgcagagcatttcaaagtaaacgggcagcttttaccgggctatgctatcgagggcgaggaacgggcgcagcctaccgctgaaaaagcagcccccaccacagcagagccgccacaggacaccgaacagagaaaggagcgtgaaaccataaacgagcagttttcaattcttatcgacagccgcagccgctttgaaacaggcaaaccgggcggcgtgtggcttcccatgccgaccacaacagagcagcttcatgcggctatggaaagcgtcggcattaccgcagacaatccgcaggattttttcatcaacgggtattcttctacggaggactgcccctttgacttgccgctttccgttatccaaagcgcaagcatggacgagctgaattattttggaaaacttctggaaatgcagagtgacggggacaaggataaatttgcggcggcggttacacatggcgagtatgccggaagcatgaaagaccttatcaaccttgcacaaaaccttgactgttactggctctatcccactgtccgcagcgaagaagattacggttattatcttatcgacgaactggacgagctggagcttcccgaagaagcaaagaaatatttcaagtatgaagaatacgggcgggacgcagttagcaaggataaggggcagtttaccgaacagggctatatctataacaatcagaacacctttaccgaatggtatcggggaacggaaaacgagatacccaaagaataccgcgttatgagcttcccacagccggaacgcggcggacaggacaagacctttatggacgcagccgccacagagcagaccgcccgaaccgccgcagagcagccacaggagccgcacccggttatccctatcgtgctgacagccgggaagcccgccgagaaattaaaagagattaccgaccgtctggaacagggcattacggaactctttgacagcgagcgttacaaggaatatctgaaagtcatgtcaaaattccataattacagcttccgaaacaccgtccttatcgccatgcagaagccggacgcttcccttttggcgggcttttccgcttggaagaacaactttgagcgaaatgtgatgagagggcaaaagggaattaaaatcattgccccgtcgccctataaaatcaaacaggaaatgcagaaaatcgacccgcacacgcagaagcccataatcggcaaggacggaaagcccgtcaccgaggaaaaggaaatcaccatacccgcctacaaggtggtatccgtctttgacgtttcccagaccgagggaaaggaactgccggacattgccgttgacgaactgacaggcgacgttgaccgctataaggactttttcgcagcccttgaaaagacttcccccgttcctatcgcctttgagaatatcgagggcggctctcatggctactaccacttggaggacaagcgcattgctatcaacgagggcatgagcgaattacagaccttaaagaccgccattcacgaaatcgcccatgcgaagctgcacgacattgacctcaacgcgccaaaggacgagcaaccccgcgttgaccgccgcacccgcgaagtcgaagcggaaagcgtcgcctataccgtctgccaacattacgggcttgacacgtcggactattctttcggctatgtcgccgggtggagcagcgggcgggagctgtccgagctgaaaagctcccttgaaacgatacgcagcgcagccgccgagattatcaattccatagacgcgaattttgcggagctgcaaaaggcacaggacaaggagcagaccgccggacaggagcagcccaccagagagggacaagaagccgcgccacagccggaagccccgaaaaaagcagatacagccgggaaagaaaagccggaagcagccccgaaagaagcctttaccccggaaacgatttacagagtgcgccggaacccttacagcgacagccgggaaaacagccacctcttgcaagcctatgtgacacaggagaacgggcgggcgaaaatgggcgacgtgctttatacgggaacgccggagaaatgccgcgagcttatggggcagctcaaaagcggcgagctgaccgagggcgacgtaaagcagctttacgcaaaggcacaggaaacggcgcagaccaccggacaggacaaggacaccttttccatttaccagataaagggcggggacgaaacaagggacttccgctttgagccttacgaccgcctgcaggcggcgggaaatgtggttgataaagcgaactatgagcttgtctattccgcgccccttgcgccggaaacttcccttgaagatatttatacccgcttcaatatcgaccacccaaaagattttaagggacacagcctttccgtttcggacgtggtagtgcttcatcagaacggacaggacaccgcgcattacgttgacagcgtaggcttccggcaagtgccggagtttttacaggagcagaagcagcttaccccggacgagctgacaacgggcgaaacaatccagacaccgagggggactttccatgtgaccgccatgagccgggagcagatagaagccgccggatatggctttcaccaccagtcggacgacggaaagtatctgattatggggaacgggacgcgggcgtttgctgttgccgcagagcagccggaaaaggcaaaccccttgaagcatatcgaggacaccgtagagcagaacgacaacaactttgacggtatcatcaacaacacccctaccgttgacgaactggaagcaaaggttaaggcgggagaaacaatttcccttgttgacctggctaacgcggtcaaagccgacaaagagcgcggcaaggaagcgaagccggaaaagaagccctctatccgggcgcagcttagggctgacaaggaaaaggcgcagaagaaaaacgcaaagcagaaattacaggatttggaaaggagctgacccatgccgaaacagagtaaatttgagaacgtggatttgttcgcttccctcaatgcggttatgaagcagaacacaggcttttaccagagcgacttggagattgacaaggagattatcgcaaaggcggcggcaagcccccgcaaggaggacaagacccttttgtggttctgccgcccgtccgggacgcattgcttccgggagcgcgacgttttcctcaaagacaccgcgccccacaacacatggcgtttctacatggagcagacgagcgaccgcgtccttgcctatgcaatcgagctaacggggacggagcgcgggaaaatcaagggcaatctgtacgaactggactacgctaaacattatgagcgcgtcaaggaaaaggagctgcccgccgatacggtgaagctgatttatgagcatggggaacgggagatacccgccggacagtttttcaacggcaatcccgattatgagcttggaaagtttgaacgctttgaagccgtacccaacgacccggacgcgctgcaatcgctcttacaggaagaacggcgcagccgggagcagcttccgccgggggatttcaaggcgcatatcgccgcattgcgggacgggctgattgaaacggaagcgcggcgcattgtacgggaaatgaagcggcacgacacgccgaacagccccaacaagacccatttcatggtagagctttccccggcgttcatgcagcttgcagccacaaaggacactgaccgccttttctccatgctgccctacaagacccttgccttttccaaaatcgagggcagacatgggacgtatgcgctgattgacaagggggagaaccgggacaggaagataaggaagccccgcccctctatccgggcgcagcttaaagcagacaaggcaaagaccgccccgaaaaaggcggcggcaaaaacaaaaaatcacgatatggaggtatgagcatgattagactgactgttgaagaaacaaaccttttgagcatttacaacgagggcggcaagcgggctttgattgagaatgtcaacgccgcgctgccctacatggacgcggatatgcgggagcttgcaaagcgcaccctttccaaagtggacgctttgaccgaagcggaatttgcagagcttcccatttacgccgctgatgaagtatgaacggggttaagcggctgacgccgccccagagccggaaagtcaacgcccttgtgcgccggacgtgctgcaattatgataacgggaactgtatcttactggacgacggggacgagtgcgtttgtccgcagctcatttcctattcgcttctctgcaagtggttccgggctgcggtgcttcccgccgacaggctactctatgcggagctttaccagacaggggacaagaagaagtgtaccgagtgcggcgcgttctttgcgtcaacctctaacagtgtcaaatactgccccgtctgccggaagcgtatcacccgcagacaagctgccgagcgcatgaggaaaagacgcacccctgttacgcagtaggtgcggaaaatcccttgatttacagggctttccgggcgtgaaaatcggataggcgatactttatacctttacccccgaaaatggcgttctactgcgtaacattcacgaaaacagcacccataaaaagacagggcgcggaagtcatatactggcttccgcgccctgttctttttttgcctatctgacatttcccttttccatttcttcaagcgggaactgcgggagggcttctatcagcttctttgtgatagactggcgcatatcttcgttgatttcctgtttcgtgcttccgtctggctgtctgaccgctaccgtcgatagcctgtcgatttcgtccttgtagcaatccacgactttctccaccgcccatttctccccggcaacggcggcgcgtatggtttcatattccggcattttctggttttccatgctcaacgctcctctgctttttgatagccctatcatagcacagcggcggggattttgctatccttatccgcgttctgtttccttttcccgttccggctgtctgtctgcctgtaaaatgctgtcaatgttctgcttgataatatcatattcccggactttctttttcaattttccatagtcggcgtaaagggcttctttctgcgcttggagggcttcatactccgattgcagcgcggcgaggttcgggagcttcgcaatgcccgccgctttcagtgaccttacggcggcttcatggaggataattgcctgttcctgtccggcgcggtacttctccctgttccttgccttgcggtatgcgtcatagacaggctttgtcttttgataggtggaaacattcttgataagcaccgccatttccgcaagccgcttttcggcgttcttcaatgcgtctgccgcctgtccgctttccgctgccatttcctcaatccggctgactaaatccgcgtactgctcaatcttatgttccgtcaagaaattcattgttttagctgcctgtttcagattgtggattttcgcccactgttcatagcccttactctgcgctgccttgatactgttctcaatgtcgataagcagcgacacgccgcgctgctctctgggagctttcgccacctttgtccgtctgcccgctatccgttcccttacggcttcctctgtatagtctgcgccgagggttttaaggcgggtgaagcgttcctgtccgggggcgcggcatgatacatatttccccggctttatctcatagcccgccgcctgtaaccgcgttagcaattcctcaaaactggaaacttgggggataagcgcgtcaacagtggttttcagcttgcctttccaacttgtacccgtcttttctgcctggtactccgcatagctctttcccttgctgcccttgccggggacgacaacggacaagccattttcccggcacagcttgtcgctcatgttccgtatgccgtaatagctccttttgttggaattgtatttatggtggtctacaaagttcaccgcgcaaaaaatgatatggttatggacgtgtcctttgtcaatgtgcgtcgtgagtacatactcatgctgcccctttgttaccgcgtcggcaagctgctttccgatttcatgggctttctgataatcgacttcccccggctcaaaggactgtatcagatgaaaggctaaattgttccccttttggagtgcttgcgacagggtatattcaaactcaatatctgccgtttcataggagcaaccgaaagaggacacaagcattttcccgtccgtcttgtccgggttttcgatatagtcaagggctttgcttagagtgcttttaataggcttaatctttgtaaccgccatatctccgcaagcaccccctttatttcctctatgtcctcttggtatgcgttccccgtcgcgtttacgcggcgtgctatctggttgacgttgacaccgattttctgtatctctgcggtcatagcctttatatcggcgtggtctatctgaatgatatacccgtcaatggcaatcttccgcagatacgccgccatgttccgggtgggtacgagcttcattttttccagtattaaatcccgttccgcttccgtcactctgaatttgatttgcactgtccttttgcgtccgtccatgtgttcgctcctttcctttccgttccgagggtttgggacacttcccaacaagcaattttcaaccgacgcgccgcagcgcgggagggcgaaaatacggaagtggtacccgcttcctatgcttgctacgaatgtttttatcctttaggctcttatcacctactacggagaaaaagcgattttgccaaacttacgcaaaagaaaaacgctgcaacctcaaaaaagattacaacgctttctaaatcctgttcagttttaagtcggacattcctattcgccctctttttcgacttcggaaatctcctttgccgttgcggttacaatccgtatgcctgtatcgctcataccgtcaagaagcgcgtcaagctgccgccgctgcgtgttcttctccggcggcgtttctaaaaggaattggtctacggatatatggtaacgctgtatcagctcaaagaatatctgtaaacttgggtgctgccccttgttctcaatgttcgcaaggtagcgcggcgagataaacatttcgtcgcctactttcttgcggctctccttgcatccctcacgcgctgcctttatcgctgccccaaaagccttaaagtcgtatcgtggtactggtctttttgccatagttattcaccctattacattttactgttcccctttcttcttggatatgtctacgtagttctatcagttagccaaaataattcatatatatatatgttgacaacaagctgcttttgtatataatattatataaaagggggggaatgtttatgttacatagcatgcgtattcgataagcattgaaatcaaaaaagatttttcccattttcaatatgggcttttttgtcatgcttattttgcgtatgctatacaacaaaactaacgacgtatagacatagtataaaaactatgccttaattttgttgtagtattatatgtataaatgcaggtcaatgctcatgttgagaattgacctgcatttttttgcgcaaaaggagaaatattatgcttgaaaaatattggataaaatgtccaatttgtaacggaaagacgagggttcaagtattttataatacggtattaagaaattttcctcttttctgccctaaatgtaaattaacgcatatcgttgatgttgaaaaactagaaatcataatcaaaaactctgaaaaacaaactttttaattttgaaaaggaaggatatttaaatgaaacacttacctaaaagtacacctacggaaatattgaatgacccatacggatttacttacaaagaaatgtcggaagtaattggagaggataaagcaagagccttatatacggaattgtataaacagccatttcacaaagaaaatctatcaatatcaacaaaaaaagtctataaaagtagcgatactgaaaagtatgtttatgaattgaaagataacaggtatattgaaacggtttttattaaacggcgagatggtgggactgtttgcgtaagtacgcaagttggttgttctgttggctgtattttttgtgagtccggacgcaatggttttgttcgtaatctaacaccgtctgaaattgtgcagcaggttgtattgatacgtcaaaaagtaaatcgtatcgtttttatgggaatgggagaacctttattcaattacgacaacttgattgcagcaatccatattcttcgagatagaaatggacttaactttccaaccgacggcattaccgtatcaacagttggtccagttaatcaattaaaaaaattgcgcgaagaacatctaaaaattcagttgacaatatctttacatgcagcaacacaggctgcgagaaactgtatcattcctcatatgcacatgtacgctattgaagatgttgttaagcaagcattgtcctattctcaaaggcataatcgaaaagtggtatttgcgtatttgcttttaccaggtataaatgaccgttcctcagatataaggcaacttgcaaaatggtttaagggcaaaaatgttatgattaacgtgctgcaatacaacccgacgagtaattcaaaaattagagcaccacaaaaacaagaaatggttgcgttcaaacatcaattagagcaaacaggacttgaagttaccatgagagtttctcatggtagagagattaaagcagcttgtggacagttagctaatacatataataaagccaaaaaacaacagaaataatttaattaaaagagccagacgcacagacgcagagccgataatatgcagtttgaaatactgctgttatcggctcttttttgattttaatttgtgcccctaataaccatattggagcaaaatcagaactgttgcttgtcgttctttgatttccgcagcagctttgaaaaatcaaagccgccgtttctttttatcttctaatgaaatgacgcggtatcactgttgaaatcggcggctaaaggaggtagccgccatgaagcaaaaagcatatcgacaaaatccgacagttattgacttatcaaaaaaagcccgcccaccaccgggggaaactacgcttatatatatgaactgtctaatcatctggatactgcttacaatgcctatgcgcccgtccgggcttttcggacgggcgcattttgtacgttcaaaaaatttttgaagaaatttcaaaaaatcttcggcgtttttgaaaaacgccgtattgccccgcgaaaagggggggaagcaccaccaactttccaacgagaaaggaggtgagaatgtggaacctaatagcagggagttttacaaacagtgtgcttttcagaagttttgtaatacggtattgcacaatgaagcttgcgacacccatagagaacttcgcagacacaaggcaaaggaagtgaccttttccgacatgaccttagacgaagcgcggcagcttcatacgtttgatgaatatttcaaacgtgaagccgccgaaaccgtctttgagaaagccgggaagaaaatcacgccaaagctgcttcttgaagcaatccgtactttgccggaagaaaagcgcaaagccatattgctgtattacttcgagggaatgaacgataccgagattgcggagctgttcaacacgtcgagaagcacgatacagtacaggcggacaagctcttttgagaaattaagaaaatatctggaggaaaatgcccttgttccttatcctgtcattgtggcagcgacaaagggcgacccggacgccatgaagattgtcttgcagcatttcagcggctacatagcccgcctctccatgcggaagctgtacgacgagcgcgggaacgtctattttggcgtagaccacgacattcgggaacggctgcaagcaaaactgatgatggctgtcctcacctttaaggcagaggaataaaccgcagcggcggcgggacgctttctctctcccccttttccgttccgctgctgacgcggcagcaaagccattctgaaccttgacaaagaaagcggcgcaagataacggcggcgcagcatagggcaaatcggatacgttccttttgcgccgagccatacggcgggtgcgccatgacgctatccgggtgaggttatccccgcccggacagccgagcgaccaacaccgcgccggaaagcaagtgtagcggcttgcgggcgacgacacgcagaatatacaatgatacttccttacagccacagtccgagcgttaagagcgtcgcaggcaatgggtagggcggcatgagaaccatgccggggtgaaattcccatgaggttatgctaataaccgtccgattaaagcctttgttttattgaatagtggacttgctgctattcatagactatattatatgtttgcgaaagaaagggggattttctttgacgcaaaaccaaacgcccgttaccacaacggagcataaaataggaaaagttacttaccttgtatgttcgtccgcaagtgaacgcgcaacggacacactggataaaaagataaaaaaactcattcgcaaagacatggaactgaaccccgcaaacgcccggaaatagggcgtttcttcacattttatacatgacacaggcagcggtatgtggtataatatagacagtacaaataccatgcttgtctgtcgtcggaaaggaggacaaaatgttacagacagacaagattaccgctttatattgcagattgagccaggaagatatgcaagccggggaaagcgagagcatacagaaccaaaaactgattttacaaaagtatgctgacgaacaccactttttcaacacgcgctttttcgtagacgacggattttccggcgtgagctttgagcgtgaggggcttcaagccatgctgcatgaggttgaagccgggaacgtggcgaccgtcataacaaaagacctttcccgtctgggacgtaattatctgaaaaccggggagctgatagagattgtctttcccgaatatgaagtgcgctacattgccattaacgacggtgtagacacagcaagggaagataacgagtttacccctctgcggaactggttcaacgagttttacgcccgcgacacctcaaagaaaatccgggctgtcaaacaggcaaaggcgcagaaaggcgagcgcgtcaacggcgaagctccttacggctaccttatcgacccggataaccgcaatcatctgatacccgacccggaaacggcgcacgtcgtaaaacagatttttgcaatgtatgtacggggcgaccgtatgtgtgaaatccagaactggctgcgggacaatgaaatactgaccgtcggggaactgcgctaccgcaggacagggagcaaacgccacccccgcccacagctcaacgcatggtacaactggccggataagacgctgtacgacattctgacaaggaaagaatatttagggcataccataaccgggaaaacctacaaggtatcttataagtcgaaaaagacgaaaaagaacccggaggaaaaaaggtatttcttccccaacactcacgaacctttgattgatgaagaaacctttgaacttgcacagaagcggattgccacccggcaacgcccgacaaaggttgatgaaattgacctgttttccgggctgctcttttgcggggactgcggctacaaaatgtatgcagtacgcggagccgggacgcttgaacggaaacacgcctacacttgcggcaactaccgcaaccgggcaagaaatgatatgctctgcactacgcattatatccgcaaaagcgtattgaaagaacttgtccttgcagacttgcagcgagtaacgtcttatgtgaaagagcatgaacaggagtttatcgaaacagccaacgagtgcagcgcaaaggcagtacaaaagacgctgacacagcagcggaaagagcttgacaaggcgcagaaccgtattaacgagctgaacatcttattccgcaagctctacgaggacaacgctttagggaaactttcagatgaacaatttgcttttctgacttccggctatgatgaagaaaaaaagacgctgacccggaggattgcggagctgtcacaggaaatcgacaacgccaccgagcgcagcgcggacgtaaaaaggtttgtcgcactggtacgcagatacacagcgattgaagaactgacctacgaaaacgtccatgaatttattgaccgtattcttattcacgaactggataaggaaacgaacacccgcaaaatcgaaatcttttatagctttgtcggcagagttgatacaggtgacaagcctaccgaaagtatctcctatttcagacagataggagccgacgtaaagagttatgctatctaacatacatcaaaaagaggtaagataacaccctctgcaaaaaaggtatcgttatcttacctcaacaaatgtagtgcccgaaacaccattatcgcagtattcaccggtcagaatacttcctgacagattcctgcttataaattccccgtttctctgcagctgatgactaatggaatcatcgttttttattttattgcttctaaccgataagcgtgcataagatccaaatctgtattctctaagtgagaaaataacttgttcttcaaccagattccttctgctttttctagccacacatgacaccgccttcccctaagctttccaggaatgtttccattttctggttaggcaattctgtacaaatctgtctgatttttgctatgacctttctaaattcatctttaaaccagaacgtaatttccagatttcccttttcggagacttgaatactctttatacaactaactaccagcctccggtcaagttcctttacctgaccgaattgcaaaaaatgatcaatccatgcattcttaccacagatattccgaaatatattatcattttctaccttttgctgctcaatcagcttttccagttcagtacaacggcttgaatactgttttttcagctgaaggtattcctctcttgtcagcagctcgtcctgatagtcaccgtataatgaggcagctaatttcatattcctctggtaatccttttttaacatttccatccgagagctttccttctgtaccctgcggtccgaaaatggtattgtatcaacatatgacaagattgattttaaatcagtaagaacagaaatatggtattgtatcagcagaagaatgttttttttcaactttgattctgaaaccctgtgaggcgaacatgtcctgctattctccctgttggtagagcacacataatatccatattcctttccacctgctttcgtggatttgcgtacaagtgattgatggcagtctatacattccagtagcccagaaaaaagatatacggtttcctgaccaggcgctgtccgcgtatcatgctctaacaagtgattgacaatcataaaatcaatccagctcacaaggggaggcattgccccctctacgacagcccactcctcttcgcttttgtagattattttctttactttaaagttcggagtagtggtttttccttgtatcagtattcccaggtaagcggtattattaagaattcttcctacagctacggcagtccaatggctacgttcatattttttaaatgttgtcctgtaccggaccccctgtgatactttatagtctgccggcggcaaaataccaaggctgtcaagccgtgttgcgatggcatcctgacttaaaccacagagtttccagcgaaagatatcccgcaccacctccgaagcgatagggtcaagaatcaacctgtgatgatcatttggatctttttgatagccataatacgcgtatgccccgacaaaaagtccctgctcacgcatagcctttaatgtatttcggatactgatacttgtatttgccggatagctttcatttaacagacttttaatgggtaatgttagaaaatcctctttgcaggattcggcttcactgtcatagttatcatcaatcgcaataaaacggacgccccactccgggaatctacgctgtacataccgcaatacttccgtaaaatctctgcccaaacgactcagatcttttacgataatacagtcaatctccccacttttaatcagattcaggattttcttgaaaccggggcgattgaagtttgtaccagtatacccatcatcgactgcttcaccgatgatttggatttcctgttgtccgccacaataacgctgtactatgactctttgatttttaatgctgtcgctttcaatctgatcgccatcctccacggataagcgcagataagcataagcacgatagatatgatttttacgcataaaaacagctcctaaccacttattagttagcgcatgaaccctgggtcatacatcaaataagtagcaggaacctgcttaaatgtttagttctattccgcttttattttaccatgattcattccagttgtccacacctatctaaccatttatcaccttctttttttctcttttgcgaatctcaatcaacactctgctttttctatcaaattttcaattatgtcggataaggtcctgcccgtacttgaataagatacctttatcttcatgtcccccacgcggaacaggtagggatttactccttcgtccagtatttttctcattctcttctcacatggtaaagaggtatctatttttacactattcaaatccaccagcgtatcaatatcaacctcatccaactttatctgttggaaagcatccagctcttcaatcgtaagcatttctctatacctcccgggacaatgattttctttacatcttcttaacgatatttcacaaacgccaaaagtgtcatactcaatacagaccttatgaaatggttgtatctatcatctcccggttccatcacgaagggtaaatccggctttattcatgttttctttaatacaagcagcagtctccagtaaaaaactcgcttctctccctgaacagccttttatgatatttataaaggccaatatgtactgttccttcgtgtcaccaatatctgaagattctatcaatacagggtatacgttcaatgcctccaatacattcaagtaggattccatacttaaatttctcaaaccgttttcaactttactcatatgatttgcagacacccctgcccgttctgcaagcttctctattgtatatcctctttcttctcttaaagtacgaatgttttgagcaatattaaaattgttaaccatcttcgtaccatactcctttttaagtttgaatgtattttacatgatgatttcctgtttgagaacggactgtaaagaccaatatcatccaattctagcgtataatttgccatttcagattttccgacataaatccagaaaaaaagaactgcctgtagatggcagctctcttacaaaacatattctattttcaactaatgccgtaaatttatactcacgcaactttatcatcattgtcattatttgaaagggctattttgcttaaactgcctttcatcgactcaattgtgtctaagtaaaactgaagttccaactccggacattcctttaagatacataagaaacgtgacaatagttctatgctcttttccgtcccatctgcttcagataccaaaacaggaacaacctctaaagcttccagtatttttatatatgttttcatgccgattgtcctggagccagattctaccttactcagatggctatgtgatattccggccaattcggccagggcttcctgggtcagacctctttcttcgcgtgcccttctaatgttctctgttattgaacatgtatgatccttcatatgtttgtctcctgtttaccgtttatcgagtgtccccatactacgatttttcatcgcaatacacgtttaaaattattacctatcattttttcactttcatctcgcaagcccattcacattgatttaaaatgctgccatcacaccaccagtagctctctataatcagcgcgactcctccactcaacggtttaccataaaaatatgtgctattatagagcatgcctttttctatgtcaacattttttgatttaatagacattttttctcgtttactcgaaccatatcccatcgaaaaacaagagacatctcaaagatcagagatgcctcttgtccagctttaactttctgtttctatcttttctaagcttaaataagcgtccaaaatacaaagcatcacccgcttttgctctggcgttaattgatatatacgttccagcaattccttatcagcattatcctccgtatatccaaacagataattgggggatgtacctaaaacatcacatataatgaataaaagcgaaacgctgggaagcttattgccagcttccaactgcctgatatatccatggtttacatgacacctttcagccaattcctggtatgacaatttgcattcttttcttttacctctcaacttagcaccgaattcttttgggtccacatcacacctcaccatctatatgcatattaccattagctacttttgttatcttctagtataattccactttcccctccgcaacagtccaccaaaatatgacacatgttatatctcagtttcatttgtatataaaaagattgtctatttcagggaacatttgtagattagttttactagacatccatatgaataaacgttatcttatagatacgaaaataaacttttagataacatttcggaggaaaatactatgaggctggcttcaaaatttttaacagcactagaaggtaatttcgattcttcccaggtcgagaaggcgttctttgaaacaaatcaactttttctatcgcaaagtgatgtaagtgatgaagatatctctgatttactggatgtttgtaaagaattctttcctttaccctatcttactgaagacaaacagtatgagcaactttgggcccggcttgaacctgcatactatcggcatataaaagaatgggaacaattcactcaggctatagcgcgctgccgaaaaaagcgcaaactaaaacggctctgtattgcttctcttgttagtattctttttattattacttttgtattgcttattgtacaccgtccagtttccaaatccgaatgctggatttgttcgggtaaactccaatcgtatatctcgtatgagtctgcatttggtgtaataaacttaaactcacgatccgttagtactattccaaaaggaagttgggagggaaatcatagtgtcacaatcacctcttccgagaacggaactatgattataacctcacccattacctccgagagctatcgtgcagatatatatatgcaggctgactcccagccagatgaatctcttatatcaaaatatctatgtacggattgtgtaaagatatggagtgagaacaaatacgatgtacttctcatggacgcatcaggtacaccttttcctatatctgatagtatggaacttgctttgccaccatatacagtcactgcgtcttccaaaagtacagaatgcatccgcattacctttgagaaaacgaaataaaatacgagctttttacgtaagatacatacacaaaagaaaacgccacatgaacatagtgaagtgttcatgcggcgtttgccaaagtaacaatttacatcattttgtccggacacccaccctaaaatttattttaatttattgcattaaaagattgttgtattttttcacatcatatccgtttccgattcgataaatggagggatttctgatttaagaaaaccgtcccaaaaatcatgatttaactttaagtgtttcataacctttgcttttataaaagaattgttcataaaatatgaataaatgtcttctttagtaacttcctttattacagttaatttatttgtgacccaccaatcaccgctatattgaacacaatgtccctctgctttcacttgaaaaagtcttattgcagataatgatcctcttttatagttttttatggattctaaatattccgttctgcctggacacaatgctacgccctctattgttgtacaaaaatgtaaatagcaatcctgaaaatctgtaacatatggatttcttacttttactatacatggtatattgagtcgatattcacagccttttgttttcaaacgcccatttatttcaggtatagccttatatccatacattggttttgataattccagatttccaacatcaacatcatcacaatcatgaatcacttttattattttaatatcacataaacgtatcttaatttctttatccaccacagaatgaaaaccatctggttcttgctgttcacgccttaaaataagttcatgttttgttatttccactggaaaggctattatatccatattattctttaaatatattttaaaaacataaagtcttacattactatatatttttatttcatttatataaattctattcattttacaataatcgtggattaaacacaggaagtcgctttcatatggtaacattgtcatgttattctgtatatttcttgtctggagaatcatgtgcttctccctgtttctttcccatatttcaaattcgactatcattaatatttccttaacatatttttttatctcatctatcaaattaaccctccacaaaaaagctattatttagacttttatgttacttgttatttcgtaatttgtcaaactttggctcgttccattaacaaaacaaaatgcaaaagggagccgcaataacgcgctccctttaataatcatcaaccaattacttgagaatattctaaatatacagagacacagattatgcctcctcaccctttttcttttcttcataagttatataagcgtccagcatacatatcattgtgtttttttgttctggactaagcttatacaggcgatttaatagttgcttatcatcgcctgcttctgcatattccaagaggtaattgggggacgtttccaactcatcacacaggctcaataacaatggcatactgggaacctttttcccgctttccaattgtcggatatagccgtcatgtacatgacatagatcagccaattgctggcttgtcaatccacactgtttacgtttttccctgattttcctacctaatctcttggtattcatttaatcccaccattcactaatagttacatttgttataatttagtatacaatccggttcttcaaatatacagaccaccattttattacatgcattaacttttagttacaaacaacagtaaaagaacaatctaaaagcacaaactatcagccctgttttcagcggattttattgttacattccgctgcctgcccaaaattccacatatctgtatgcattactgtctattatggttccataatctcccagtgtataaccatagagacgcagggcacatgtccttctggtgtctatcaggtcataattgtaactatttgcataaaaagggggttttgaattaacgcctgcaagatagctggtatatacttgattaattctgctatacgcacaatatcccttctgggaatccctcctgtatcagtgcctcatatctagtttgattgattacttttttgttatccaccacttattcctccatattccatctgcttattctaaatcatttctgcgcattatcgaattttcttttctcctggccggataatatctggaatctgtagttttaaccgctccgcaaactccattgcgctaacaaactccgttttttcatagtctacaagtttttctggcagattataaatttctgtatcagcataataatataatccccgcaaggttccagcatcatatccgaaatcctccggcttatattccgccatactttgcagacaattcaatggccagcattcaaccttttcatcctcatcatctgcaaaaatatagtctttgccgtcctgatcaagccgcagaaaatagattatatcctctgataaggcagagataataagagagtggcagccatcatcctcaaaaccataaatttctcctgataccatcttatttatggagatatcctctatcaattccatttgttggacaatattctggatagtctttagcatttcgtaatcttcagatatagattttgaaaatatctcacccaattccgcactaccaaggtcgtttccaattatttttccattgtaatcaatgttgcctgcgtttggttcttcaattgcaccgccagatttccggtaaggaagagtataaaaccagcgcccttcttttatggtttctccatatatgactgaaccggcaaattcgtgttcaaatgacaccgccacttcccggcatcttcctttcaatgtccagcctacatgttccatgtttatttctatgctcaccacctcctattgatagattaatgtctgttcttcgacttgaatatcacgatctgtctggataacctcacacgcccgtccttcaatctcttcccagctcaacccggtaaaattatgaatgcaggtaattagggaacttccctgttccatgtacagatactcctttgtaccggcatcaaaaaacatataaaaatcaaaatccggttcaaagctgtcgtcctcatcatcttcatatttttcataccagacaccgctatgtatttgcaagccaagttcctggataaccaagtgttttttgtccagccagacctgatgttcctcatccgtttcaaaaaggaagttctcgccatcccattcttcctcttccaattcctccagacggcctattgtagtattgattttcttctccataagtcacctcgctttttcctttgcagagcgcagtttttccctattctgctcaaactggctcataatatctccctgcagcctgtcatgaaaatcctttgtcactggatagcagatatcctgatattccgcctttccttcaaccatgcgtcgctgggaaggcatagccacaaagttatttcctgcaaaggatcgtttgacagaaatctgattaactacaaatacatcaccaatcacaagtctggcatatgccttagtggtattggacaaatctctgttgtttactacctgaacataatagtcaaaatcttcctccccataagtgaggtcaacttcgtttttccctcccatacgttcctggtacgcctccagaatttctccccttaatgcggtactgaaatccgtagtttttggaaaaaacacatcactgtatatcggcttattctgttcatctttttcccccgttggatactgcggcatactcacataaagattccctgatcttccctccctgatagtgataccggttactttaaatctgtcaccgaacgttaccgcagcaaatgccctcagttttttatctttctctgttgatacctcataaatatttactgtatatttcataatttagtctccttctacttttttaatgaattctatctggacatcgccggttccgggagttcctctgttaccaccagttcttctccctcatcttttatctccagctcgttattgatttcctgctggcggattagtttttgtttcaactccgattcataggggaattctttattaaactcccttttagattcctccatatttcttttgtactcttccagtttttctttatgtgcggcaactctcttttccaaactccccaacaggttctccatacggaccatatttccggaagcactgctgctcatatctgccgaataagtcagttccccactcagctttatgatacagtcagaatactttttttctaccactacatcaaaccccttatagctgcccaccgtcctgctttccatactttcaagggaatgtgccatctctaagataacgctgcccgccgcctcacgttcatcatatctaaggccgttcagagtaacgaaaaagtccggctccatacagagtgcctggtcacgtttcctgatatctttttccatagcatacaatcggttctcagtcttcttaatcaattctggatatttgaaaaggaaattatcctgatggacatagcgctggctctcatagcttgccttcaagacctgcagacgcgaaacttccgtgtctacctcggttttttccataatcataggattcccagacgcaattgccttgatttccgcaaaggataaaatggtttcgtctacgtcctgacattccctttcaaccgttttgtctgtcattatctggctgataaacctctgcttattttctacaatcccccagaggtaactgtcaaatgtctttttcgtgatatagcggtatatattgacttcttcattatcatttccctggcgtatgatacgcccttccctctgctcaatatcagtcggtcattttttgcggacagttcaatacatgcctgtctgtttcgctccctgctcctgcgtttgctctcgtttgatttctccctctgtatcttcttggcacaagcaggacaatacttcgatatgccagagcggggaacatattcaacaccgcacaccgtacaattcttaggctttaacgcagtccaccgctttgtcggtgtgatatgtaattcaccgacaaagccgatgaatttataataaatcttgatttcctgccgcaccattccgtctgtaagtttctcacgttccgaaacaagtatcttgtctataagtgcgtttatgatggttgcgtccagttccttaatgccttgatagttgcggattagggagaggaaatcacggacaccctgcgtcttctcatagctgtcgctgagcgtttccgttacctctttcagccttgcttcaatttcaagctgttctttctggtattttcccgacatcatctcaaaattccgctcggtaatacgctccatcaccttatcttcatagagtgaggaaaacagcctgtccagttctgcaaggcgtttgttcagttttctttgctccttttccagtgcctttgccttgctctggtctgtttccgtgagccgcttttcaatcgccctcactgccttttcatcattgactgccatatccgcaaatcggttgatgtcggtgaggacagcgttgaacaagtccctcgcttcaatgctgtgtgcggtacacatgatattaccgtatctgccataattattgcaggaatattgtacgcagtcgatgatgtcggggcgtttcctcctgttggcactcatagcccgcatcgcatagccgcagtccgcacacttaataacgcctgcaaagatgttctcaaagccgcccttgttttctggtaatctgcggcttgtaataagctgctgtacggtatcaaattcctcctgcgtgactatcccctcatgggtgtctggtatcacttcccattcttcgggcagcttagaggggcgtttcttgcttttcatgttggcggcaatccgcttgtagcctgcaaggtttcccgcatatatcgggcttcttaaaatgccccttacgctgttctcgctccaaatataacggttctcctcattctcctcaaaatacctctcatagcctgttgccccctgctccgccgcataagcggcggggcgtaagatatgctgtttgttgatgtgcttgcggattttggcgattccgttgcccgctaacgcaaggtcaaatatttcccttaccacatgggcaactttgtcatctatcagcagatggttgtggtcggcggggtctttgacgtaaccgtatggtgctgtcgtccccatgaatttcccctgctgaaacctcgctcggtacgccgattttatcttgaccgacacatcggcggaatacatttcgtttaggatgttgcggaaaggcgtgatgtccatagcggatttattgagcgtgtccacgccgtcattgaccgctatatacctcacattatgctctgggaaaaacacttccagatacagtccgcaatcaagatagttcctccccagacgagataaatctttcgtgataacgcagtttatcagaccgctttcaatgtccttaatcatgttctggaaacttggtctttggaaatttgtaccagagtaaccgtcgtccacatacgtttttgctaagtgccatccctgctttttcacataatccgtgaggatggatttctgtgtcgcaatgctcgcactctcgttatccgtgccatcgtcttttgacaagcggcagtacatgccgacttcataaatcttgttctccattcttattcctgccatactgtaaaacctccatatctgtcctatctgttttcatgttccattgcgtacattctaagcggacagcccctcattgtcgaaggtgtcgccctcggcaatcttcttccgaatatcctcggaaataatcgggataaacgcttctgtgactgtctgcgtgccgacatattcacggctgattatcatctgaactggtgctttcggcacgatacgctttctctttttatctgctttcttatcctcgcccatacttaaatcttcctttccagacagggcaggagaacgtctggaaacgccccgccctgtcaatcagataccatcaatccccgctgtttacttctttctgtaatgcttcaaggagtgctgctgcttcatcagcgttcaacgtgataccctttccgcacttctcacggttcggggaaaagctgcggatgtcatatttcggctctcttccgttccatgagataagattgatttcttttgtgtagccgctgtcgcccttagacaatacggcgatttcctttacaatctcatactggatttctttcattcttcatacctcaattttctgcatttacctcccgaaaagagaagattagcggctgtccctgccccgtttcctctgcaattcacgctccaaaagtttaatgatggtttcctccatctgcttcggcgttgtgttcttcggaaaatactttttcagcttgcttgtgttgattttcaaggtttctttctggtttcccttttcctccgtcataattgcaaatatcgtatccatgtcaagccgcccgctctggcttaggcttttcatccgctgtgcctgtgagagtgagggcgttgcttcttcgctctccatcgtggcaaagaggttttcctgctcgtctttcttcaaaaaggacagttccaccgcaggcgtgagggcgattttcccctcgtccaccatccgcaaaatcggcggtatcagttccgtcaaacggataaatctttgtacggtcatcctgcctacgccgaagccctgtgccaccttgtcgtccgtccgcaacttcgtcacaacttgtgacgaggttaagtctgtgcggaaaccctgccgcttcatggcttcggatttcatcttgtaggcaaacgcccgctctgatggcaggatattctcacgctgtaaattactgtctacaagggtgatgatggctcggtcacggtctaagggcaggacaaacgcaggcacggtatttatccctgcaagttcagacgcacggacacgccgctgccctgcaatcacttcatagccgttcccgtcctctttcgggcgtgtgattatcggcgtgacaatgccaaattccttgatgctttccgctaattctgacagcgtttcatcctctgccacatgaaacggattgtcgggaaacgggtacaagtctttggtctttaacaccttaaaatcctgtttcttcattcacatatctacctttctttcgctctgcttttatggtttttctgcaattcttccaacacttcgggcggtatctttgagagcagccgccccatctgctcgttggttctctgcaactcaaatatcttctggttcgctttctgcacctttagttcctgctcatacttttcatcacgcatacgccccgcatagtctgattcctgcccgatttgctcctttaggctattgatataggcactctgcttactgatttcctttgagaatttctccacgtctgggagccatgccgcaatcagttccagagccttgtcacgcttcttccctgcattaaaggcgttgatgtcggacagtgcagacacaatttcctcatactgtttatcaagcctgccgcccaacttatagagccatgtggggacatgtttccgcttcgtttccattgaggactgacctctttcaagctgattccaccgtgaggacatccgctcatggtaggcggtctgccattcggacaggctcttttgattgcctaaaattgttttggcagacagcttattgtctggtgtaatcggcacaaaacagaggtgcatatgcggcgttctctcgtccatgtggacgactgcggagaggatatttttctccccgacacgctctgaaatgaaatccagagccatcgtaaaatacgctttctgttctttgggcggcaggctgttcataaattctggcgaagccgtgataagcgtttccaccatcatcacgctatctttcctcgtcctgcaccctgcttcggctaccatgcggttaatctctttcttgtaggtgtacctcggcggattcacaagatggtagttatctttcgagcgttccatatctatatctggattgcttttataggcttcttttttacgctcgttgtggcgttcgcaagccgcaacgccgcccgctttgcgtttctggaaacgcaggattgcatagggcataattcatcatcttcctttcttcggcgggtaaactgccctttgggtgacagcggtgacggcggtgacagcagttttgggataccccctaccgactgcctcaactgtcacccttattccctgcatgacggtcatgtcgatgatgacggtgtttttggaataccccctcgcaagagccgtcaccgtcatgctgccattcttttatccgaagcgtggagcgtaggataagcagggcgtaagacctgccataagggagtccagagggaacgtctggcacacgactttgcagggcaaagtgtagtgtgttacaccctgtaaacgcagtcggaaaaatcggaaggatttttctgaccgcaggggtggttttacacgccgaaaagggcgggtaaatcctacgcctgcactttgcgtttacggggtgttctcccgcagggatgacagcggcagggtatcctaaaatcactgtcaccgccgtcaccgctgtcacccgcagggcagagtcgccagctttacacggctttaagcgtcaatgacagtaacagggggtatcccaatatcgctgtcaccaccgtcaccgctgtcacccgcccgctttgcaagcgaaatctgcctgccgtgttttttgcggctgtactgataaacgatatggttctcatttaaaaatgtggtgcggtattcattgagccatttcgtaatcaccgtgggtatggtttccgtttccctcatagcggctaacagctccgttgccgtgcctgcccattcttccttatccctcataaaatccaccaaccgaaaaaggacgtctggtatcgtttctttcgcaagctgctcctgcgtttttctctccacaagttcccaactgcaatcacggaaacgcagcgtgtattcctgatagggcgtgtccctgcccgtcacatacagcttggcggtgtcggatgcccgtttctccttttccagaacaaaggtagcgtccgcactccccgttaagcctgtcgtcccagacaccttgttgaacacatcgctgtcattctgctttcggatgtggtgtacgacaatgaccgccaatgaatgcctgtcggcaaagtctttgattagtgagatgtccccatagtcgcttgcgtaggcattgtcttttgaagctgtacggactttctgcaaagtgtcaatgacaataagcctgctgtttgggtaatctttcagataatcttcaagctgcacgataagaccgtctgacagcttgcagcttgccacggcaaagtgaagccgcctgctcgcttcgttcgtcaatcggaacagcctgtcctgtatacggcagaacgtgtcctcaaggcagaggtaaagcacgtcgccctccattgtcggcatatcccacaagggaagtccctgcgacacgcataaacatagcttcagcatgagccagctctttcctatcttctgtgagccgcagaacagcgacaagcctgtggggataaggctgtccaccacaaaggacggcttctcaagcggttcataaaggagcgtttcggcgttgactgtctgtaacttctgcatggctttcctcctttcgggcggtgtttttgttttcgttgcacataggcgttgacctccttaaaaatagatttactcccacgaagaaaaagtgagagtatgtaatgccgccaatcccacacaaataaaaaacagatttctttttcgggcggtgtcggtcacggttggagatacttcctcatttccgcctttactttctcctttgcaatcgcaacagatttctgtattgccgaagcggtgcaatgctccatagcggcgatttggtaaaaattgaactcatactcgtagtagagcaggaaacgccgcctttgtatctctggcagtccgtcaaccgccttacagagcagttctgcccgttctgcctcaatcatttgttcctctatgctcttaggcagcttcaacgcccgcctgttcagcgtttcgtcccatacttccgaaaactccctgtgccgctcgtcccattggaggagattcctgttcctgcgttccatctgccgaaactccataaagaactgttccgacacttccaactcgtgggatttgccctgcccgtccttaaagctgataaaataccttgtgccgctttccgtggattcctcccgaagcgtgtacgccttaactctgtatgccatcccgcttgcctcctgcaaaaaataagtgaggggatttccatccctcacccagtagcccgcaggacggcaggctgttttagacgctataaaattttcgtagcttcttccgcagatggtctaacctcgcatagatggcaccagtcgtcaaatgcacgagcggggcaatctcctttgtggaatacccctgcattttcagcaggacgattttcaaggtacgcccgtccaccgcgactaatacttgatagagattttcgctctcaatctcgtccagtaactccgcaaccgtacccacttccgtctgccgctccctgtctgccatgtcctcaaggtattccgcaatgtcattcgtccatcggtaaaaccgcctgttggaattgaagtctgccctgtccgcaatgcgtatctgctcaatggtcgcttcatcaacgccgcactcacgcagcagcttttcctccgcttctttccagatacgccatttcctgtcctcccgtccgtggttatatgccatgcttcttttcctccaatcagaattgattgagagggcagagaaaaaccccctcattttcccaaaggaaaaaacaagggggctgaacgccttaaattttaattttctattatctttcttagttttcttaggattctggctttgcgtttgttcacaacgctctgggttatgccgaacctcgccccgacttcacgctcagaaagtccgtcaaaaaagattgcctgtatcaattcctgttcactatccgacagcaaaggcagggcggctttcagcctgtccaccataaccgcattgacaacggtttccgcaatgtctgccgcttcatcagcgataaagtctaaaggcttcccctcgctgtccgtaaatccatccagagaaagcaggctgttcttcgtatctaattttttcagataacgccaccgttccttatctcggtagaagtccgtgtattgctccctcacgacttcaagcagacagccttgaatggggataaacagcttgtccatataggtctggtcggattccctgcggcggcagaaatccgtataggacagttccacatatctgccgctttccttgatatatacctttctcggtgcgtatttcactgtaagtacctcccatctgaatttttgaaatgttcaaaatccagatggagaggtggcgaacgacacctaacaccactaatagccctatggcactttccaacaaaaatcgacaaaagaaaaaccgcaaaggctctatgacctttacggttatgggaaatattaattctgttgtatggagattgtacttctacattcaaggcaggaagtgccgttgcataggcagaaatttttttaactggtttcctgccgttctctgatatgctatgtattgataaattttgcttcgtatgagcagatagataactgcccgaaaaaaggacataaaaaaatccctccaaatttaaaaacaaattcagagggtaatttagggtataacaaaataacccacccgaatatcgttttttttatttggtgagtttgttctttcaaatacgaaacaaaaagagccgatgattcgtgaattgttccacaatttcatcggctctgcgtcttaagcgtctggctctttgatgacagttatcttcaagttgtcaactttaatcaatctttcttgtctgcattttggacaataaaggggataattctccaaaacagtgtccttcctaattttattacgggttttgttcccacaaacaggacacaatatccattcgcatttcatcataattagtctctaatcctttcaaatctcattttatatgacttttgcaagctgttaagctaacttgtggaacatatgccgaaccttatctatacggctattcgggcggcggggttggcaaataaatttaccaatagctggctggtatccttttaactctgtcaagcagactccctgcccatttgtgaaataagttaaatcgttcctgtattcttgaatacatctagcagggatttctcctttcagaatgacctcgtcattctttatctgagtacttacaatatctgcacaataccttggagcatcatgatacgcccgtgagagatattcctgcggtgcataaatttcaaagtggagatatggctctaatagttctgtccctgctttttttaaagcctgctccaatacgataggggaaagcagccgaaagtctgcgggggtacttacaggactataatacaatccatattcaaaacagattttacagtctgtcactttccatccatacagcccctgctcgcagccataaagaaccccctccataaccgcattttggaacgattgatttaaatatccaagtgaaactctgctttcatactgcactccgcttccaatagggagcggctctatggacaacccgacagaagcccagaaaggatttggcgggacttctatgtggatggtatattctgcttttctaagcggtctttccatatatataacagtaggctcttttatttctgcctccacatgatatttttcctcaaggatggcacaaatgacttccatctgcactttccccaaaaaagaaagtataatctcatgcgttgtagtatccacataatattttaaaagagggtcgccatctgaaatttctgtaagtgccccaagcaatatttcccgctgttcagatttctttactgcaatcgttgtttggagcatagggagaggattttcaataaattttctctgcggcaacagtattccgttccccaaaatactgtttagctgcaaaacatcatttggtaaaattacaatatcaccagagcaggctgtatcggatgaatataattcaccgtttgtcggaacacacatctctgtgatttttattttctctttttcagatattctaataacatccctcaaatgcaatgttccgctatatatacgcacataaacaaaacgccgccttttctctgaatattcaatcttaaaaacctgcccgcatagttcagattgaccttcaggcgttgatgaataaaatttactggcaatcacttctataagctgccgaatccccagattgtttttagcgcttccgtgataaacgggaaataacgttccgttttggaatctcctgttttcttcctgttccagttctgacattttaaacggtttccctgacatatatttctctaatagttcatcgtttcccataattaccgcatcccactgttccatatcgtcattgtccgttacatttatatggggatgctgcccaaccttttgcttcactataatttccgaagaaagctttgctttcatttctcgatataccattggcaaatcaatcccctcttggtcaattttattgatgaaaaaaattgtcggaatcttcattgtctgtagtgcatgaaacagtatacgggtctgtgcctgtatgccatcctttgcagaaactaataatactgctccgtctaatacggataaagaacggtatacttccgccaaaaaatccatatggcctggcgtatctataatgttgacttttacatcctcccactgaaaagatgtcactgctgtctggatagtgattcccctttgacgctccaaattcattgtatctgtccttgttgtgccttcatctacgctccctagttctgcaattgcaccactggtatacaataaactttccgttaatgttgtctttcctgcgtcaacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgagactgctactttttgttcccactatcaaattgacagtttatttaagaataccttgccgcatatttattaactccttgtataatactgaatctaattatattccttaaccctttatttgtcaagctgacaaactaaagcagaaaaagcggcaggatttccccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgttgatgtcggcaaggtaggcgtttagcctgccgcttgtaagaagattggtgtatgtaactttacggtactgttttagataatctaaatgccgttgcccccagatgcctattgcctgttcttcttcggcgggtacagttaagcacggtatcaaataatccccttgcctttcgtatttgccgcccagttcctcaaataatgattttgccattgtctgttacctccacattcttttttattttgaatgtccgcaaaatccgtcctacatccgaaggtttccacgggcaatcaatgtgatgagccgcgacaaggcgtttttggatattggttcctgttcccatcatggacgtgcttcccaggaggattcgtttcctgccgctcctcatgtctgcaaataattcctctttctgcttatcactatgggcatcatgaataaatgcaatttcatcttctggtattcctttcctgatcagctcctgtttcagaaagtcatatacattaaatttcttgtttcctgtgggcgtgccaatatcgcaaaagacagcttgtgtccccttaaactcctgggaaccaatgtattcctgataaatattctctgccgcctgaaagagtttgccgtcaccatctacttccgcatctgggtcaatcagccggggatcggtgccgagcaaccttgcttcgttggtgatcttgagcatgttatcgaccgttggatctacattccctgctcgtattgcttccgcgcgtttagccagttcctgcatcatgtactcaacactctcagacgccacgctctccacaattttgtatttcccaccttttaacttaggtacattcaggttcagcattgaaggcaattggatatcagccacctcccggaacatattcataagctccggcagattacagaatttattgaaccggctccgcattcggtatccgccctctggtgacatttcaagcgaagtggtaacttcgccaaaattggccgcccaactgtcaaaatggtcaatccccttctcatgtagtttctgtgactgcagatacaactgcatgacatacatttcacacatggtattggagataggcgtcccggttgcaaggataacatttcttcctccggtcagttcctggatatactggatcttttggaacatatccatagcccgctgggaaccattggtggaaatacctgccacattacggatttttgaaaagatagacaggtttttaaacacatgcgcttcatctacaaacaatgcatctatccctaactgttcaaaatccagaacatcatccttttttgcatcatttctcagacttaaaatttgggattccagatttttccgttgacgctccatatcttttatcccccatttagccccctgctcctccttcatctccgcaatggcccccgaaattcgttccacctgattttcaagaattttcgcacgcctttccgcagacaggggaatcctctcaaattgagagtgtcccaaaatcacggcatcataattatttgcagcaatcctacatgtcagctttcttctattttcacttttaaaatcttctttcgatgtcacaagtagattggcactgggatataagtgcaggaattctgccgccatctgccccacaagatgattcggtacgacaatcattgctttatgcatcagcttcagccgtttcaactccatacagatagccgcaatttcataggtttttccagccccaaccgcatgggccagcaaagtgcttccatgcagtgcccggtctacaacattccgttgatggtcccgcatatttatttccggattcataccggggaacgataaataagaaccgtcataaacccgcagacggttatcattgaagttctgattgtaaaaatccacatatttttttctacgctgcggatctttccatatccactccttaaaagcatcttttatgagggttgccttttcccttgccagagttgtttctttctgatttactacataccgttcactgtccccaacttcaatcttatctttgacggtaattacattctggttcagtaacgcctctatgatggaatatgcatcaatcctttttgttccatatgtctggcttgccgccacagaagaatagtcgctggatttattagtaaccttgtaagacatagtatatcggtttaactgtaccttgattgcataagtcccgtctctgtactgatccggcgtattcagcgtctcatagataaatgcctcataatcttcctgatcaatccaagaggttcccaactttacgccgatttccgttgccgtcaaatcttccggctgcaccgctttcagggcttctacatttgccaaatagacgggattatcttttgcatacacttctgcagcctttagtttattccgaaccggaccgctcaaatactcacttgccgtttcccatccctgattaggattcccatcagccgctttgactgggtttaagaatacctgcccttttaattcctgcaggagccgttcccgttctaccggatagacactcagcatataggggatatgtaccttcccatattccgccaggctgactttcaacgcgtccatggctgtatccaccttcttaactatggaaactggcgcaatagtctgtttataaaagatatccgccttctttatattcttgttttcatcttccgtttccaggctgcataacagatagtagtcattgtcctcccggaatgctaacttgttggcacggctggacagatatccatacttctttacataaggatcataaatcttatttagcttttcctgtgcctcaacaagttgatctgtactgcacccatgtgtctgaatatcaatcaggtatctgaccgactgccggatagcatgcattccaaggatacgattccgttgcgtctcgtttcccgaccatctcaccatgatatcattatcccggtaatagatttctccctctatgactgtatatgtgttatttgccacatctaagagggccggcatggtattgggaagttcttccttgctgtttacatcagggagcagcgttttttcctctaccggacaataatcggctgatagaaaagaaatagcatgattcaaatcttcttcaagattaaaattttcctcatcttctacgatcagttctgtataattagagttttgaccataggtatgcctgtcaaaagccatctttcccagcatcatttccggatggttcatataatactcattgaccggcaccccatcatcggtataggtgatgttcatccattcctctgatttatttgtggacagtacacttcccttcttttgaaggaagataatgtcagatgtcacttctgctcccgcgtcctttttgaaggcaatccctggcagacgtaccgcgccgataaagtctgcacgctccgccaagtattttcgtatcgtggaattggctttatccatggtgaattttgttgtgacaaccgcaatgattcctccagggcgaagcaggtccatggattttgccaaaaaataatcgtgaatacggaaaccatactttttatattcaggatcaaaaattttgtacgcgccgaaaggaacatttcccacgatgacatcaaagctgtccttttcaaactttgtcttttcaaatcctttgacttcaattgcggcatgagggtgaagctgttttgcaatccttccactgatactgtccaattccactccataaagacgggaatcccgcatatcttccggcaggacactataaaagttcccgacgcccatactgggttccaagatggaaccatttgtgaacccaaactgctccaatgctttatagattgacttagcgacaacgggcggcgtgtaaaatgcggaattaatacttcccctggcctgctcatattcttcctctgtcaacagcgtctgcagttcctgatactcgtttgtccagtttggactcttaggattgaatacattagcaagacctccccatcctatgtatttggcgaggatatcctgttcctctggtgtagccgggcgggaggactgttccagttcctttaacagacggattgctgcgacattactcttatactttgtcttgtcaccggaagggaattcccatccatcagggtaaaaaaaatccgaaacctgaatgacgttttggtttcggttactcatttccttatataataggaaggtttcttccggacatagggcaaattcttctttgcgtgccgcttcatattcccccggtggcaggtactctcccacatcaatggctgcctggattgcacgcgatacttcctgcatggtaaaagccccatgtccttcattttctccattcacaaggcggaattcaacgactccactttcaccatacgtgtaatggatcaatccccagcttgtatttagcgcagactttccatagtcctgcttagactgaactttcaaaatttttgaaagaaattcctgtttttccttttcccctgcctgttcaaagaacctttgaatcaatggtttggagggaatcaatgccatggaatgaagggcatatgcatttgcagcctcttcaaatactgcctttaaccgttcacttcttccatcagcctgggtctcctgtatttcttctcctgtatcctctgttcttttgtcatctttctcaattacggtatccgcacttaaatatggtattgttactgccggtgtctcgccggcctgttctaataacccctggtattgggacgccagattttgaaaccagggaattcttttaatttcctctacagagaaatcctggctggattcaggatattgatctaattcgattatccgggccagaatgtcccggatcacacgccacggataggtctgcaccttattaccgtcaaaagaacaagaaatctctccagcatggaaggtcagtgttgaggtaaatatccaatccacatctgaaccaagcagggaaaggaaactctgccgtataaattcggtttcctgctggggcagtaagtttatggtcattacatcataaatcatgtcaaatactatcctgccatctgccgtttccaggaaattttctactgtttcggccaatgattccggtatttccacgtccttttttattggctgatagtattccccgctttcgattaataataggatttcttctgccactatcttaaatggaagatacccacttagatactgcctctgctcatgccagtataactggattcccgtattatctgtctcatattcaaattcaagtccctcaccagtaataatggtgtctccaccttcgtaaatctgataaagaaattcaacacgctcctctatcccttcatttaactcaaagaaatcatagatctttttctttaggataggttccagtgcgcctgctaataccacttctctgcataattcatctgtcacttctacaggcactggttcaacagaaaaagaaggaaccgcaacagcagttccttcctctatatcagtatctattacctcggcttgcagattacttcctgcatcacggtttcctgagctatcatcgctgcttcgtttcgaagtctggtcatctccatcgtatccgccggattgatgttcctctccaccgcttttatcctcacgtagtcctccacgatctggtcgtgcagctcccacgcttccgcctctatctgtttcagcagctccggcagtttgcccgtccgcagcaacaggctgtaccggctttcctccttctccagcaggtattcctgtgccagcttcgcgtatctgcccagcgtctccagcccttccgcctgttggctccctgtctccagcatcgggtacagcagcccgtccttttctttcctgtaattcagttctaccatcttgatttctcctttcatcttcccggatctctttcgcaatctctgcaaatctccgcaacgtcctctctgcaatatccgatatgaggatacctattttggatagtatcacctcttcctggtagtttgttattgcagacagtcctgtatcaaaagtatcaatcccgcatcgccttaataccaagtatgcggtgctctgcaggatgaattcttcaactggtgacatttgtttatcgtccaattcatccttgctggtaagaactgctatttcatgaatcctgtcgttttcctcttccattatagcacgtacatatgttctcgtaaagttttttattgctatcctgaaattattttcttcctgatattgttctggaaatagcctctttgcaaaagcaggagcattttcttcattgatttcccatatccaaggcataacccttccgccggtgcttttgatatcatagacatactgcgcacctcccagcatctcaatgggaaatgttgcgattccaatctcaccgcccctgacataacgctttgctttcttccagtctgaaaatcccaggaggatttctgcctccgggtattgttcgtaaatgatacatgtattcaaaaagtcaaaacgatataaattccccctggcagaaaactccagatattttctccactgttcaccgtcacgcgagatatcaaaaattgcaatatcatacaaatctgataccttcatggtgtgctgatccataggttcaccttctttcccggtctgccatagtaaataaactcatctgttccattttgggttctattttctctgggctgctttcaataatctgtctgtattttttaaaatcaggtatctcacggtgccttctcataatgacaaaatcctggttcctgattgcatcctccaattcccttacatttcttaatgcatttctgatttcaagcccattatccattttaggacttagttccagtccgcataaatactgatagtccacatcgtccctacattgacggaagataccaacggctgcccaataaatcttttccgcctgtaccataaaatgttccggcagcttctccggtgtctttcggtggtaaatttctggaaattcccctgcctccttcatatcatacttcgcgctaatgatatggtttcttaacaggttcatattttgcccgtcagtataataaggatcactgcctccacttaatagttccttgtcccagcggcaaaaagagtcttccagtctttcttttaatgtttccctactcatctcccacccatattccgcggcttttcccgatggatacccaccattgacaaggttacaccccgcaggtcgctgtaatccaatacataaccactttttgcgtccgaataattgtcatgtgcctctgataaggatgattccatgctctgtgccctgaccgtcactattttacttaatgtttcggttatgcggatatcataatcctgttctttggtatcgcttatataaacaacttgcttctccccacattcttctatcccaaaacgcccactcaattcttccagtaatgtatctgcaggcttccctagcatatctctggattttatttctggtatatagaatttaccatcatcacactggaaaaatgggattttctctccatccttttctactcccaagactagctgcctgtttatcataccttcctgcagaccgtccagaaacgcctcccgtgcctcccacagccccatccaggctttatacagtattacatggtattcccctttcatcctgaccttttcaagataataaaaattgtcctccatatagtcagacattggcattctcctttcaaaaaggcagtcttgccgactgccctcaattttttcttcatttcttattgatttcttcttttcatttacagcatgtttatccctcctcagtttcattacctttaaattacattacgattagaacttcaaagcaaatttgtatgctgatgctaccgacatggccttccatacaaaccgatgttagacggaaccaatggccggtaaaccacgccatatgctgtccctcgtgcgtccacctgcatcccatttcctacataaatcgccacatgcccaatagacataaattcccccgcatttgtatcacgggaatggaagatcaaatctcctggccgtagttcattttcactaacctgtagaccattgtctacaatatactgtccctgtgttgatgcaacggatggaaggtttataccaaattctgcatataacctctgtaccagagaactgcagtcataatatccttcctcataccgcaaatcctggctatactggcagccaaccttatctaacgccgcaagtgccacctgctcgccaatgccgcttgcaggcatactgtgcaggaattcgtcactcatgacctcacgcagcaacttctcctgactgggtgtcagtttgccaagttcaatataatcttcataggtaaggttgtacacatataatgaggtgtgtgttacttccaccgtgttgctgccattggaatcagccaaaaatacctccatatcctgatgtccaaaattctgggctgtcccatggtctccaaaatacatatcaaagtctacaccataacggtcaaaatctccggtatcctccaccacatattcctttccgcctgctatgatatgtgtccccataggaagcgtgggattataagcatcaacggccagggtgtggtctgctttcggcatgacgccgcttgccgtaggacctcccgaccattggccacagcagatagaacagttgcaataaccactgaatgtcatgattccaaggctttcaccggcccggatcgtatctgtcactgtctcagatgcaaagtggttcatttcatcaaaaatctcctttaagtgctttttattcttatcactcatgacggttgagaaatttccctgcccggttccataacgcaccatatataccatcatcacatcggtaaaattgctacgagccacgccactctgcatatttttgtaggttacatcctcatcactgtcttcttccgccgcccttacttcctcgttaaattcccggtaatactccgataatacgctttgtaccgtatccccttcctgtaatggtggtagaaagagagccaaaggggtgttatacaggattacaataatcaggacaaagggcaaggcaatcgtaaccagccctcccaataacggccccaacagccccagaagatacaaaacaagctgtttgacaaccaatccagccctcatgacggcgatatcttttgcggcttttgcaaaactgtccttttgttcctcaccgcttagcttgttcaccatgaaagcatacatgcgcctccggatagcttttttcatccgggtattttcctgttccttttttacccttcctcgtcttacttcattctttgaggatatcttctcatctttttttctggtctttaatgtatcccggtcctctcccggcatttgttgactttgaaatctgtcctcagacttctggtccactgcttcagaccctcgctccgttcgtgtgagggtcacggtatctttaaatccaaaatcataatctttccgtttaatatccggcccggaaacattgtctaagtgaaacttaggatctttgctggctttttgcttctgcttttcccggacaaagttctcttttggtttctccttactcttccgcactccatcatcttcaaaatctgcgttcttctcacttccagccaaatatctgggataagtttcttcccttgattcctggcgtgattcctgacctgacttctttttctcttgtctgggtttcctgtctgtatttttataatccagggaactctctttctttcctggctgctttctaaaccctgatacagaattcgctgcaagaaccgcacttttcttatcttcttgttccttcggctctgatacaggatgaatctccgtggacttcatgtggatctttttatccgataatgaggctttttcatctatacccccggaaacaatcttttttccaagaagtcccgatgcagaacttttttcagttcccaggtaattatgcgtttgtaattttacttctgcgtctgccttcagctttatctgtgcttcttttttacttttaaatcggttgtcaatgattcgtattcctcccttcagctattgctcatatctttttcacctgataatagaggctttcaaagtggaatccttttacaccctttattgcaggactgcagaaaccaaaaggaagctgataatgtggatcatacttttctttcaacattttgtatgcttcctctgccgacacatccagttccatgtattccgttccgtcaggcatatacttatcactgaaaaggactacttcttctaaagttcctttctcaatcagttcactaacttcctccggagtaagtaaagttccacacttctcatatacttcatccttgagtttccgaaaattgtataactccctgtcttccagcatcatataatcccgttcaaacaggacggcgatctgatttggaaacacaatagcctccacattcatttccctgcaggctgtccgcgcttccctttcggaacggaatcggtattctctcggtatttcgatttcaacctcccactcatacaattgaaatccaatactgaatccaaatctcatattctcaacccacctttctgcaaaaaacggctgcaaattttcgcagccgtttttccaataaaaaaagtggccactagaagcaaccactttttcttgtaatacattcttcaatttttatttatccacagaccgttttccagacagccacaacgtactggtgcgcctgtattttatctcctatagaacatttttatcctttaaatatctttcaatctcaccgataaactcctttgccttttcaatctgctcctctgcgtcttgccttgaggcaatgaaaaaatccgagtaatccgattgttcacgcatgatagaggcatttttgattattttagaagtctccttcgcaaaaatcccagttttcacgaaattttggttaaaatacgcaatcacgccgctatgtttactggaatcaaatccttccagtgctgtaatggcacgcatggcatgaaaaatagaatagtaggaacggttcagcgatggtttatacataccgcctgacaacatttcttttgccgcagctaaatcctctaacgcacgctggtaacggtactttgctaatgtctctaagctgcccacagtaccaccccttcttccttcacgttcttatagaatggtaaagtatcctcccactccaaaaagtttttatagtcaatatacagaatggaaaagacctgatcatattccaaatccatatccaccgccaggtccaccatacggtcatgcatctcttttgtttcttttccgttcagtagaactgctatatcaatatccgattcctttgtattggttttacgggcaaatgaaccatatagtaaaatacttaccaatttatcaccgtaaatatcacgcaggccctttaccagcctgtcaaacatttccttattcttatccacgccgattccctcctgtcttatcttttatatggatattgtaccgtattttttgcttttattcaatgcatatatgaaagcctgttatctggcctgctttcgctcctttggattttgtaccccgtgctgtaccggttcaataatcttcacttccggcatcagtcgtttgatatcctcaattgctttctgtaccaatgggctgtcacgataatatgggatagagttgataatatccacatccagccggtttgctgacaccagatcaaactcaccggaatagatagaatcatcgtccttgattgtgaatccaatcccattccccatgcacgccatttcttccgggagattcctgtatcgtttcacagcttgttccaggctcctgcactgatacactttccccaacgagggaaactccatacattccgccacgtaaaatgatattgtgggaatcggcttctttccatactctactccgttttctgcagctatttcattatatattttcttcccatcgggcatcatattcgcctccttcatacttaaataggtttcctttcctaatataacgtggtctaacacagtgataccaatcagttctccacaagccacaagccttttagtcattaaaacgtcctgtttggaaggtgtgcagtcccctgatgggtgattatgcattaatataacactggccgcattggaaaggatactggctttaaagatttccctcggggagagtatgcagctatttagtgtccccatgctggctatatttacgttgatcacctgcccattggtcttcaggttaaggacgaaaaataattccctgtcaacagaatcgaattcctttaataagagttggactgcatcattcggattttggattttatcctcactgtatatgggtggatcatcaaccagacgaatacttaccattttcagcccatttgccttcatccgcacccctcctatctatcaccagtaactcaccatcttcaatacagtttatacgcatagtaagttcgctctgtgtcagtatttccacattattgttatcctggctatccatctatctttttgcctccttatgtgtttgtatctgtgtgctaccgtatattttgtccagatacttttctgccgcttcatctatggaagagtgaatatggcgagacacagcagaatacagactcaaactgccctcgaaggaatctccccaatcgcgcccatcgcgcacggccgacaatattaaatctgctctactgggtggtatatccggatcaaagtaaagtttatcctctaagtaccctattttgttgtcactcacaaatttctccatagcatcaaacttttgttcccaatcccgtaaagtttccatattaagaagctgcttagagaaaagtggaatactgccatactgtctgactgccatgtacagccagtccatcttttcattttctatgcgtatcacttcaaattcatcccttccagcctcattcttcagtatttttcgtttcctaccatatacctggcttacgaagggatagtcgtgcgaattaaggccgcggtaacacaatctgtcaaaatccgggtctgcaagttcaaccgttgcaactacactggctttgacttcctcaaaacgatcatgtttcaaatcatccagattaacagatatccatctgcttctgtttcctgtcttcaaaaccctacactctattggagggaataacttttgtaccccgtttactttcatttcaggcatgatgtttatcttcctttcccatgtccagccaatttcatcttttcttccatactgtcaggaactttactatcccgtccggctctgttatccaaagccctctgcgtaaaaccgtccaatgatttctgcatattttctgtgtgccccgccatacttttcacaattttcccacaaaattctatggcttgcctgatctttgccacaatacccttatcgtagtcatactcaaaaacatccgctgcatctttccccataagaagatttttagcatttttccggtgtcccttcgctgcgctaagttccatcccaatatcccccatggtccgtgctccatcttccaggtttttggcagattgttccagatgctcatgaattaccgacagcgccctgcctgcttttgatttatcaataaacgtgtatagtgcctgttctccataatactttacatgcctctttacatgccccactgcctgtttaatgccttccgatacctcatttcttaaagctcccagccatactttcgctgcgtgcactctatctccggacgccttcacaaaattgtctattttagctttcagggttttatcatttaattcgtctaactgcccgcgcagatacagcagttcgtcctgcatatcctcaaaatacttttccatctggttaaaatactgtaaaaaatcctccaggttctgcgcctgcgcgtccatgcggttttcctccatcatggcaaacatttcttttaaatgcggctgttcccccaagggaacattcaacgatacctccatcatagctgcctcctgttatctctttttttctgattttcctgaaatactgcttaccttttcctttttatcccgattctctgcttcaatcatacgttcatttatttttgcatcgttaaaacactcaaagattgcatccaggtcaatatcttccggttcaaggacctggtaagagtttacgaggaaaaaagcatgttcggatatcaaatcataatcggattttggaattgatgttatctcaaattcatactgtaacagctccaaacaggcgttgaaaagctgttctgccagtgaatccccacgcttatacaaaagagggatttccggattctcctgccaggtccgcacactccgcaggatacagtccaatgtttctgtattgcaggaccatgtatccgcttcttctatctttcccttctcgcaatgttctggcacaacgggttctggatcttccaatgttccttcgacaatcatctgtaaaatatcctttcctgtccctccagccttaaggacccgtgccgctgcccgcatctcatatggatacaagcacaatttctcttgtgataaattcaggaccttaatcgccgtttccttgctaaactcagactgaatagcagaaaaaacatgataataggaatccaaccacttctctaccgctttattttgcggcagttccctaaaaccagcatactgccccatggcaacacagtcctccgcccatttcacccaggtcctaagttccccgtctgtttgcagttccagcagatgctttactactaacacaaagatatctctattcaacgatgttcctccaatctttctacctcgtctttggtggttttttatttgcctttgtctgctctggttttgccattccattgatggagcagtatctctctactcctgccctgtcaaattcctccaggcgtttaaggtcaaacgccaccttataataactttccatgcccgaataacccatttccagaagcacctttccaagtttgtgctttttaataaagtccagtttgcttttactggcaaaggcgtcaatgtatgcctcatttctttcgacaggcatatgagccagattgatggtcagatcagcaaaagattcctcatatccctcctccatatgggtaagaccgatatacagtctgttgtcataacgataggcatcaacttcaagcatcagctcctcatgcccaaattcccaatcataacccaatgtttttttctcttcttccatttccttacctctcataattatgaatactggtcatccgtctttattccctgtttgtttttttcatgaagatttgtattgaacaaatcatatatgatattattcttctttaccctggcatcaaaaggaataatgacttcaccgtgtttcaggattcccataccggaattacagccgttcacgtatttcaactgtgcttccggaatccccgctacccgtgaaagctcctggctgtccacatttgcctgttttaacaaagcaataaattcagagttcgccagcatggttacggctgtgtaattctggagcatatcagaaatattctgggtgatggcggtacacaagccgccttgtttccttacttttttccacagggaatagagaaattttcccgaatattcactgcgtccagaatgttccccggttcccagcaacacatggcactcatctatgtatagccatgtagctcttcctttttctgcatttctggcaatccgtgcccggacattttccagcatgaccagcatcgcaatcgcactcagctcttttccaagatcacggattccataaacaatgaaccggttgtctacgtctaaattggtttgatggttgaaaatattcaaggaaccgcttacaaacagctcaagccccaaggcaatatccctggcttcctcctctggctgcttcatcagcaggtcataaaaatccgacataaccggcacatatttttccttgctcatggcaatatccagatacagcttacggatacaacggtcaatgatggatttatgccggctgtttagcatttccgacatcgcctgctcacacagaccaagcataaattcgcccttatctcggatcagtcctttactgtcggcaaggtccaattcattcacatcaagccagagcggatttatataattctgggtgtaatttgacaggttgatgcatacaccccctaagttctgggcaatatcaaaatactccagtgtcggatcgatgacgatgatatcatcacctgtctgcaaatatacccccaacatctcggacttacagaaaaaggattttccactgccgggtacgccaaataccatagcgtttccattggtcagttttttccggtctgccacgcacaggtttttagaaatcctgttcgttccataacataagcccgtgggttcataaatctcctgcacattaaaaggcattaaagccgcgatatcccgtgtaagcatggtgcgcatggtttcgacttgtcgcacccctacgggcagagcagtatttaatgcctctcgctgttggagatgatgtacctccatattacagagatatttgtttcctatcgtctggattgtctctgtaatactgttaagttcttccctggtatccgcaatcagtaccatatttacacctgcaaagaacaggttctggtcattctcccgtacatcgtccatcaacgcttccagggttttcttttccactttctttccataactgatgtcacttgcaaagtcattgtttttattacggacacgctgctggcgtaaaatatctgactccacacccagatattttttctgcaatgttcttgttgtcaggtcctttggcacaggcacaatatctatagaggtgatactgtgtacaggaacattggtaatttcattaatgaaagtgtccggcaggcttgtcggataccttctgatgaatacagccctgcagattttccggtctgtttcaaagtcattcggggaatacttaatcatggaaccgcagatatcatttttgtaatctgttttactttttacatacgcatcaaaatcaaaagaaaatgtttcttcgtcaccaatgcgataaaaattatacagaacccggagccgttccgccgcgtcaagcggctccaactttgagcctatcgcatggaattcttgctgcatccctccttcaaaggtattaaaaaatgcttttgcctgttcataatctttccgttccacagtaaccgtaagaaagcgttcctgttcaatcccctgttttcccgctacaatccgttcctctacgatatcattgtaaacgtcccgaagatggtcatagccatcatctttatctggtatcaggacattctgcctgaactggctcatgttcctgtttttgttgtatattgtaatcttaaaagcaacatcaatcgcattaaccagcttgcaatactgctttaagatttcatactggtctccctccgacaccgtgacataatttatgtcagcaaaacggtataccctgctgtaccggttctttgtattctcaaaaataccatcctttgcaatcctcagaatctcaatctgctgctgaacactcttcggggctgcaaacaatggtttgtccgctttttttaactgtatgaaacgatctgtaaaaattcccacttccgtaaacctcctttaatccaaggcaggctacgggaagtagtttagcgaatcccgtaacctgctggtcgctaaactacttcccacatatgtgggattatttcatatcttttatttcatgagcctaaaggcaagtatccctgccactgccacaactaaagcccccactgtcagtaggatcatgcgctttgcttttttctttaccatgttaaaatcctcctgtccgtcagacagtccttttttttcttttttctgctgctgtgtagcaattttctgctcttctccataggcgtcctttatccaatccacattttccgtggactggtataaacagggcttattgaaaaaagacatctggaccattctccccaccgtctgccagaaactaagcccattgtgattataaaatcctgtgagtgcaatcggcaccacaacaggcgttgccagatagcacgctaatgtcatgccgattttatcgtataaaccgagtacaattcccgctcccgcccccagggacaggacgctgaatgtaaattgcttcacggtcagccccatcaggaagctctccttatagtgctgtaaatccctgctgatttcgatatccatttatctcaccttacctttctttacattttcaatcctctttttcccctcttcaaaatattcctgactaatctcaattgagatggaatcccgttctgattcaagggcagcttccgcaagggcaaaggaaccagcatattggtccaataccagttcttttttatctgtaacaaattccagtatctgttttagcagttccaccggcttctccgattgatgaaccctatcagcttttgagattggctgaatgtcaaaagccgtaggaagcatccctttcgctccggacatatagtgtttcatctccggttctgccttgtccttctttgcgtccggtcgcatatcacgcgcacgtccttttgaaaagagcaggatatcctcagtattttttgccttccgccccgtattggcaacgattgtacccttccgccatgccaccttcgcgtaatattcaaagccgctttccttcgccatggccttcacctggtaaagatattcgtaattatcaccgttttcctccggcagaaactccacgaggaagtgccccttctttagaacacggaatttttcgtccaaatcctgctgtgtgtactggaacaaatcataggaggcaaagtcccggtttcccccttttaaactttttttcagcagatatgggtggtcagtgataattgcgtcaatgctgttatcctcaaggaaactcagatcacgtccatttccctgtatgagcatgcaggtaatatcctcattctctgcatttttcttcgtaaccgtatagacgcctttggcaacccgtttaaaaagacctttattaatcccttcgtagatacgcgcccggatgctgggttcctttacatccttttccgcatactggtatacacattcctttgcatctttcagggaaaattgctccacgtctgcgaaatactcaaatagcgtcatttgtatgcttttatcctgcgccgctgtttccacacccaaagcctcctttacttacagccccagggccttgcttgtcaggctctgggcgccctttacacttcccacagtcagggcaaccgtgaatgtcatttctcccagatagatcaaagtctttgtccaatctgcatagtctcctgtaaattgtggtaatcctgaactgataaacgtattgcaaagaataatcgccaaagccatagtcaccgcctcaaaaactacgcttatgaaatacttcgtaaactgtacgcttgtggcactcactccccgatttcctgcaaccgttgcataagcgatactgccaaacggtacgattacaagtatttttaaaaatcggaaataaacattataaataaggaaaaatccgcagatcaaaataatcaggcttaaaaataccgccaggattaaaaatacaaggctttccacaaatcccagattcttgataatatctgcctgcgccgggtctatcgtaacctgtgtggcttcactccctccaatcagtccgacaagattcccaacacttgtaaatatggctttcataatatcgacgttgtataccaccagccactgcgcgattccaatcctgatcaacatacggagaatcacttcaaaccgcatctcttcccgcacatctacactttccgaacaaaaaccaatcacaaaaaataaaacaaccaggcttgaaccaacagcaacgaaaatcggttcaatcccggttataactccccatgggccgcctcctttgaaagaagtcggggactgccccagcagttcaaacaccatgttcacctgcccgttccaaaagccgaacacgacctcaagaagcgaaaggattgcctcgcccaaattaaaaatatccatttaccatcacctcatttccgtatttggatattatgattactagagtatcatttaaaataattcttttgaaagaacaaaagccttgaaatttgtttgcatcactacctccttagatgcggcagcttatatttacccgtctccgtgtaaaactccggaagtgcataccccggtgcgagcagtgaattgtccgatttaattaatcctttatccaacatatcattgataacttcagccgttttcaaatgaaaaaaactaatggcatcataaccaacacagataagaatatcctccttaaattcagccataggattgtataaccatgttttttcacacttttcgtgatttaatttcatggcttcgattaccttttcctcgtatgcttccaggtttttctcataataatctttcgcttcaagttcagtaagaatataggctgcttgcaaatcaatggcccctttatagtgaaaggttttaccgttccgcaattttttcgctatatcagccagtgagtcaggatatatattacccgatatctccaaatcccttatccgcaaatgttcctctccctttgcaacataaaactcgtttgcatgatatcctaattgagtatagaaatttgggtttttttctctgtaatcggtatccacctggaatcccaggcttatgaataaatttttacactcttctctacattcctgactggcttttgccttttcaagtaaattgtctcctatatcaacaaaaaaaactacgcgccttaactccagcatagtgttccctccacgttttcattaaaacagcacaatcaactgatacccaggaacgtgaggactgtactaatccccgccataatcaagccggcaacgatgccctttatcgcagaattcatggaactcgaatcctgctgctggtaagactgggcaaactccattacgttttttgcaaggataatcacgccaacggcacctatgatggcaattacgagattcttcagattattcaaaggtgccgtcaccacttccgcgccagacgcatatacatttgttgtatataacatggttgccatggctgccccagcggttatactgctgattctgttaatcattttttttgcttttttctttttttcagtcaaattcttcacttaaaatctccttttctttaaaaaagggcgcaaaaatagcaggtataaaagaacctgctgcgtgcgccctctattttttgcaacagattcccatatatctgccatcttaggcataagaaatatagggaaaattaagattcttgatggccggtcagttgttcgcgtatttcacgcatttgtccggcacttttatctgatttaaagtaagtcaatatatcctggtaggaaagacctcctaccaatccaagacgtatttcttctaactgctctaatgtataatcattatttattagcatttcattaaactgctcttctgtaatctgtcccaaatcctgcttttctatattctcgatttcagttattttgcggttctttttcagttcatcttctgaaaatatctttgccggcatatcaggttcctgcaatgacagcaattcgtccagtgttatttcatctatctgaacattcagcccctggtccctctggcgttcataatattcaaaagactgccggttcagcaattcgcaggctggcactgtacttttctcacggattggtgtatgatgatatggtggtgcgcctccatcaaacgtctccttgaaaagaggatgcgccggggtattgtattttgaatctacaatcgggtcaaatccccggataaagatcaggcactttttattatccagctttctggcctcatccggtgtcagtagttcccttcccagcacatcaaagttccggctgctgctgccattttttcctcttgtttcaccagaactccgcttatctaccgtagccttcccgagcatcttagaaatataatcgtgtgtactctgttcattcccgccaaggtagaccaaagtgtcacagttccccgggatgacctcccatgtcttttcaaacaatgctttaatctgcgcaaggttctgtataataatgatcgatgaaatttctcgtgacctcatggtactaagtaaactgcaataatcatccggtaatgcaaatggcaataggtaaacctctggcactgccgcctcgggtttttcccctgccccgcaccgtgcatgatagtttcccatcacacggcgctcccccgactaagaacataatctcttagtatcggcttgaggctatccctccaccgcttattatcacggtttccctggtactgtgcctctactctcacaaccactaatgcacttattatagaagtttttctcccccttccttttcgctgcaactacgatactttgtcgctgatacagtcagctcccgtattggctgctttccacgttccacataacttaggattgctaccacttaggccgctcctttagccctgcaagcattatcttcaaggaaaatcctcaagatacctatgccctataagcacagaaggcatttcatactaacaaattttactttgccccgcctgcgtacccctggtacacctgcatttctacaggctatttgtttagagccgtacattcggaactttgtcagacctcctttgggtcattctagccatatggcagccccacccgcactgtcacacacaactcatacctctatgaatctttcctcgcctttcagcgttagggtgtgcttcgcacgactttcccgcgcttataaccccagccactgtatctggctgacgctactcggagtatcagtgaatccccttccgggcgttaccccatcatttgagatttcagttatgcagttctccaaagccattcatggcttcaggctgcggttttgtcggttatttctaccgttttggacgcagaacgtgtcacaccattagcaaactcatcaagcataaaggtcacatggattggtaatcttccttcgtaaataaagtcagcctggaagtacagttcctggaatatctggctgtaaagcagccctacaatgctgttgttcgatttatcggaatccggaatcacacaaaaaagagctgtttttgtctttccgtcaccatttcttcccacccctatctccgggatattgatatcatcatggtccaggatacggaggatttgtggattttccaaaaaagccagtctggaatttgcactgattacaatactccggaccgtatcagccgctcctctgattactttataatactgtttgactgctggatgattgcttccctttttacgctccaggcgcttaatcctgcggtctaagtccgatggcgagccatcatcacgtacctctgcttctcccagtaatttcagtaccgtggaaaagttctgttcacttttggggcattccagccaaacatagtagaacagcgcctgcaggtatagcgactctgctttctcccagaagggatcgctgctctgggagtttttcggggttgtattggcgatcaggtttgtaattaattttacgacatctgattccttccggatatacataaatggattatagcagtcagactcttccatgttcagcagattcaggactttgacaacataaccgtgtttctgtaagaatcccccgcaggcttttaaaatttcccctttcggatcagtgattatataagaagaacggttaagctgtaataaattaggcttacaaaagaagaaactctttcccgctccacttcccccgatgaccaaagtattcaagttcagcttcgttttacgcgaatccatcctcatacggacattttggcttagtatgcggttctctgtctcgtccttctcggctaacacctgattcacctgtttgatatctgcaaatttggctgtaccatattcttttcccggcatatagtttttcctgctggtcagatacatggcaatcgcaatcatatatacgaattctgcaagtaatatccccttaaaagttgtatcattaaagtaatttccaaatgggcgggccataaccatgttaagacgctccataaaggtattgatatcaatcccctgttcccagatgccattaagaagatacccgccatatgccgccagcacaccaccaagtacaatcagccagacagaagtttttttcttattttccattaccttcctccccgctttttcagttggcctgccatctgcagtttccggttttcttcttttttcttgtgcagcatgtctctggtttcctttaagaccggatcataactctggctgtatagctcttcaccggtgcgttttccaatcacctgcccctcgttattcaccacactgtattccttatccttctgaagatttgtaaatatggtcctcttctcctcactgatatgggatatggaatttttatctatccacaggtactcattctttttgaacggaatccgtgtgagaattctcttttcagtctcttccaccgcaaggctcctggcaataaaaatctgatggatatttggatcgtctctgacagcttcctttgcatgctgcagtaccttcctctggcggctattcatctcagacatctgcttctgtgcagcctctgccttatgcggctgctccatcccccgcacaataggctccatgtcctccgcatgctgccattttccctgtttctcatacgcagcaaactcctgtttgtccattttaaaggccatgctgccatcgtcattgatctccaggattcccaggctttccatatatttcagtacaggctctacttccgcccatggcatatctatggcattactgatttccccaacacccgcccctggtgtctgtgccagatatgtcccaactgccttaaatccccatggagagatggactgttctttaggggcgctctgcttgtttgggtccgacatatccttcttgtctatcccgtaagtctctttcagttccttctcctccccgttatccagataatcctggattgattcaatcttgctcccctcgatgtcccccatgatttgattcactctaggtgtggcatcagaatgaaaaaggatttcacttttaccatccgctttattgatatctggaaggagtgcatagcggattttatatttatcagccagctttttcaccttattaatatcagtcgtatcaaaacggaaaacctgcaaatcgcctcctgttttaagaaggtcttttacggttgtccttccggataaacgttccatctccaccaacctgccgatgaattttccaatatccttagccgtatgaagcccgcctccgacaattttcatgaatatctcaattccctcaaatgacacccgcaggatttgggtagcttcctgtatttctcctatagaactcacctcctaactgcttcattctcttttttcttttcatcttcgcgtttccgcagctcctccagcatccggtccagttcatagtccacattcttatcctgcaggattttcacaagtaactgatttgctatttcctgattgatatttgccacttctaactgtatgatatactctttgattctctcctgcagttcgctcccgccccggatggcatactgctctataatcccagcctccaggttcccctgggatttttccttttccctgaccgcagcgatatgaatgaccgcatcatgcacacagtctaagtcctgctgatggaacgcataacctaaaagtatccttttatcctcctgggtaaatacaaagtcctgcttttccattaaatccatcatttggtagcactcccggaccattctgatatttaatgacaccacaccagcctcacgcatctgtatgtctcctttcccgtaccagcagcataatctcacgcattttccgcattttatcagcagtcaattcctttttgataatccgctttacttcatcatcggccaatcctgaatcaaaggcagacctgacttcttcaagttgttctgacgataatccttccgcagcgattttatccagaatatccgatgtcttctgcgggaacagcttctcaaggatagttttttttgtctgcggcggctgcggtctccaataagatggaggaacggtaggtgcagttaccttctctgtctttccctcaaccacttcggcatttgaccgtgttcttgccgctgtaagttcctcctccagcttctttatctgtgtttcctgcaccgcagcttcttcctgcagttttttgatcaaactgtctttatcttttaggttctcatataaatccttaatctcctggtttttctcgtccaggacgtgttctttcaccagtgttgagagcacctcaaacttctcgttattctctttaaactgctgcagagatgtctccatcatttttatcaggttttctgtatactccttaaacgccgcgccttctgcggaattaccagcattctttttggcctcaatcaattgtgtcctcatttttttcatccggctcgccggcagatccggtgtcgcataggacatgatttcttccttcgtaagcccagagacggaaccagaaacaatttccggtatctggtactggtcaaatgtgccctgacagcacaaatcaaccagttccccgtctacatcttcaagcattgcaaaaacggtctgacgcatctgctccgcattaagctttgggattgcaacccgccgcacgtctttaatgcccagcccgtattggaaagccatctgtattacttcaatctggtccgcccccagctttttacggcactcttctaaatatttctgttcttctattgtcatatctgcctcctgcaataaaaaaagacaatccaatcggctgcctctcgattcatttcttatcttacttttggggaatttgctttatttttctgtttttccgccttaccttcctgccaatcctgggatactggttcaaactcgctttttccatgttcctcaagccatcccctaatatcgtcaatcggtgttacaataatttttttcatgaaatcattcgcagctatggcctgatatcctgcaccctggttcaagataatcattttttctgcatattccgaaatcttactatactgggtgtggctttccagcaatttgattttttcacgaaaagacgcaatgaatagcttatatggcatggataggcatgtaatgcctcgctcctctgcaaattttagtgcgtctgtataacttttttgttctgattcagtcactttcccatcattgtcgaaaaattgatacttcaaattattcctcctatatatcaagcaatcccctaccgtacctttcctgatcgggccggaaccttatccgttatattctctaaagaagaaataagagccataattttttcactgtgaactttttccaaaacagtctctaaatagtctatgatgtcctggcgcttttcccggtctccaatatccctgtagatacgtcttaccggatcggactggttgtccccggctctcatgtatcctgcatcaagataatggataaagtctgtttccttcatcacttcgttcagttcccatgccacttccgccatttcttccttcttatctgctttcctgacagctccgacctcatctaatttatctgccagactcacgccctgctttctgtcctggtctggtaagagcgaagaacggtacatcaaaaagcaggttagatggtccctcaatctatgattgtctaagaccgctctaatcccaggtattttcccccctgctggtactaaatcacggaagctctcaatatatgcgtctcccagcttacattccaaaagatatttttttatttcagaagccagtttttccagtttatcctgctcatagatcacgactttctcctcctctttccctgcttttctgcttgtctctgctctgcattctctccttttgctcctgcatgattttcttccctatcctctgctgtcgtcttacctccgcaagaacctcattgagccggcgatttttctcctggaaattcaggtacaaccgctctgctgattcaaacgtgtaccccatatccaacaactgcgtttttagctgctctgcctgcaggtattctcccttaaattcctgatacccctcctcatataaagaaacctcaaccttcagttcctggagcttttcccaaagctcaaatatctctgtattggcttcacggttctctttttggttctttttctcctgcctaagcgattttgcctgttcagccaatgctttcctgatattttccaagtccttgtctgtatgtatctgataagccgaaatgaaattatatttctcctgtatctcatgaagtttccggatatcttctttatatttccaagcatcggaataaggctgtttttttaggacgcccagccggtataactttgtaaaatacatcttctggtatccagtcaatggggactttcttctgggaatataaccagtcacttttttgactctgggcggcagttccaatactggctccggcagttccttttctcttgcagatatggggatacttagccgttcccgtaatttttcttctgtgtaatcgccgcccagggtatccagcctgcgtcccttatccatacctggcggctttaacagaatatgcgctccctgttttatctcatatccccgttcctccactccaataaggaactcatcccagttttccgcctcggccgccacctggtcgatgtcacggcggatcatatcattccaactaaatttaccatctttaccctggtcccagatgcgttccttttttttctttctgttctgacgtactttatccatgtccagcgttgccatatggtactcttcacagattttgttgacaagcggctgtatgattttgtcccaatcaccatttcggtaatcatatttcttcccttctccaatacagcggacactattaaatgcaatatggccgtggatatgatcggtatcatcatgaagcgcatagactgcctcaaactcttttccaaggtactcctctacaaatttccctataatcttcatggcaacatctttatcaacggtatctgccgcctcttcaaatgagataatgatatggtatccctggcgtccccccatcttatcgtaccttcgcttagtgttcagcatttgtttcagtgcagtctccggcagacagttatggcctgaaacatacaacccattttcagttttgctgtccttcgtaatataattaatcgtatttgcgagatgctttgcctgaaatcccgattttgcacatcccatatgcagaattttactgatagccatacttaattacccgctatgtccaaatggctgactacctgcatgactgcctccttgatctgcttcatataaacatacagacgttttttatcggattcatggtataagccgctgttgttgtttttgacaatttggttgatgtttatcccgatatggtttatctcattcgtgagattctgtaatgcttccagaagttccggataatctctggggcggttggttatcagcatcctcagatactgcgaatcggatagccctctctcttttgccttcctgttcagctcctccaattcctcgcatgacagccgaatttctttccggcagttcatcttttttacgcttctcagtctctactcacatcctttcatcgaataaacagcaaaagaaaaggaaggaaccacagcaatcagctatattccttccctcttgatactttacttatcatcttactgatctccgcccagccgtgatatccacgggaggcaggatttcctgtatctttccacgcagctccttttgataataggtcctctggaaagcggcatttagtattttctcgtccgctttcaatccttccagggttttatgaagaatttgccattcagagtgtctgcttaacttaaaatagtccctggtatcagatatcatcttgtagttctgctcacacgcagcatcaatcacctggtcaatatccgtctccaaagaatcaccagattccatgtccaccttatacaattgtccgtggccgtctgtttctaatgtatagccacttttagttgtataccccactacctgttcagcctccgcgcgggtaagtggaaaaagtatatcaaactcgtcaagatattccattaattttccagatgtttcaattcgtcccaaatcatccccttctttccataattcattctatcagcgggaatttttcttcgccggtgtcgctttttgatttacctgtttccataaggaggtctgttcatatatatcgtctaacagcctctcatctttttttagctgttttatcctgtctatgatttccctctcttcactgcttccagctttctcttccagtctctgtctggaatctaagatgaattcattgttccattcacaggcaaggaatgtaacctcgtccatggtgatttcttctatttgttctccctctaaatccacccaatagagctgccctttttcatctacgtgtagcccataggcacttccctccatatagtccaacagaacctgggcatgttcctcattcagtgaaaatggtatagaaaagtcatcgagataggccagcagttccgtggccgtattcaattgtttcaaataatgcctccttgcccggtatcctaccggctatgtcctgatagcggcttcttatccttgttttcatacttttttaataccgccagaatctcacttatttttttacgggccgtctccggaagttcccccatctcagcatttcgcagaaactgcgcttcggtcttccttccatataatgttgccagcctgccgtatgtctcttttgccaggtcaacttcggtatctccagactgcagcttttccgcccaaacctccggcatatgatcccggactaaaatacagatatcgcaggcagcctgttgtaaatccgtgcgctttaaaataggttccttttgatcaatagaccatataccattcagcatgtcctgcgccaatctcaaatcacgctcatctgttccatttaggattgtatccacaaccttctgtagctgctggtactcctcatccattccctgtaaaggaatactcttatttttatccagtctctccataatgtcgcacacctccaagccaacagctttttgtatggattcctttgtgatgttattttccctgcaatattccagataagtttccagtccccctaaatatgtaatttcctccaatggggtgtcagccagttcctcccatgtatcataatggccctctattgtcatggctgctatcgtacaatcatcaaattccaagtcatagaacaggtcatcatctgtactgcacattccaatccggtaaatatcaggctggtcttccttagcgtacacattgaaaaataacctggcttcatcggtactcgcaactgctgcatattggtatgggctgcccttcaccctgtccttgttcaagatatacagcagggtgtattctccaaagtggtttcgtttcagatactccttactgtcatagatcaatctctcagtttctgtctgttttgcttccatattccacctcacctatttctttatcaacggctgttgtgtctgctctccaggtgcggtttataagcagagtcctgtttttccagttctgccatcttaaataaatctaatacctcccacccagtagcagccttaatagccgctgctgaaatgttgttttctttacagtattccaggtaatccgctacccccattttatgggggattgctccaatgccccacctgctcagttcctcccaggcgtccaaatggccgtccattgtcattgcagcaattttgtacccttcctccagcagcccaaacagatatttatctgtatatgcgtatccaatattaaattcaacagtcttatgcgcagaaggagaaaaactaacagccctgtcctgcccatattctgccaatccctgataggtgtcctctccgtgcgcctccatttttaaaatatgatagataatggctccctggtacttttgcgaatccaaaaactctttgttttcacaaagcactttgagtacatccatctgggggttttgtatctttgggggcagactatttaattccgtcaggactcttgcaatctgtatttccagcccatattctggctgcttgcgtttcagatagtcaagccagaactgcataaattcctgtttcttctctggattatttatttccctgcacattctttccaccgcatgtgcctctgattctccgggtaagcgcgctgcattccattccccacccccaacagcgttcagcatattgcagatatccctggataaatccttccccattcccagttctctcacctcatgtatccctgatgcttcaaacttttccggttcatatttcaatgtcctgtctcctcttttctaaataaccgttatagccatttttcttaccctgccctttacatggcggtttacctgccatttcagttttttcactatcgagtcctttttctgtctgcctggctcacatgattcatataatcctgcttctgtaattttacctcatcaagcagatctcctacactccatccgatagacgctgtaatagacgccgctgtgatatttctttctttacagtaaataaggtaatcctcaaatccctctctatggggcaacgcgtcgaggccctccctgtcaagttcgtcccagacattaaagtggccatccatcgtaatcgccgctattttatagccttcttccatcggtttaaacagatcctcatgaaccgatgtatcacctatataaatttcagtaacttcttccttagaaatagaaaaatagactgccatttcctgctcatattcagcaactcccttgtaactgacggccccatcctgttctttttttaggatatagtaaatactggcatcatgatacttttgagaatctaaaaattttttattttctacgagtaccttaattctctccataaatggagtttccatgtgcgtaaatcctttgtttagtcttgttaaaacttccgcagcctgtatttccagttcatatttgggcctcatacgttccaaatagtcaatccagaattgcatgaactcacgccgcttctccggattctttatctcctgataggtacgtctcactacgtccgactccgattctcctggtaaacgcatcgcttcccattgccagtaatcaacagattttgtcattctgcatatatcccaggccagatttttcaaaaagtccgactctctatttttgtcaggatatccatattcccatagttctccgatcaagccttctgtctgccttgtaacctcaatgctttttgcacggctgaccttatataagtaatcaataagcagcttcctggcatccgcaaaccggagcgtatccagaacattttcggtttggttgtaaggatacggcttatagaaaaatggggtaaaaatgtctcccaatggtcctctcttcatgaattcgtccacgtaatcttttaatcgttcaaattcctctggttcatacctcaatactctgtctcctttacattctgtattatctatttttctgtctgtcctgtttgggaatgtcctcctttttctgatgctcttgttcggaagttttcccccatataataaaatggcaatattcgcttttatggttctgcaaatattccgccagttcgagaaatcccatttttagtgcaattttcgtaactgcagtcacgtcaaacatattggtttcaccagtatccctgaccaccaatatctgctctttcacaataggttctattacagttccagctccttcccttttctttttgccctctttacttctgaaaatctaaggggccggtccggactggctttgccagtcctctgcaagatacggattttgccgtacaaaatccatcttgttaggggagatcccctaatacccccatatcagcctcaaaaagctgatatcattcacaattttttgctatcaattccgcggatattacgcgaaaatctgatagcagaaaagggaaactgacagcagtttcccctcaaatcacatactgcctgctatcagcttcatatatctgatagcaggcagtatggagtatgatatcatcaaaggctttgtgatatcacattccaaggttatctgctatcagtcaattaaacctgatagcagaattccacttttgtttttgatactaggttgccgcatttgatagcatcccttgacctgctgtttaaaatagttctgtttttcccaatccattctgcattgatgttctttatattaagattttatatctctgtcattgacggttcccataaaatcgttccagtgctttctcgaaggcacctatcccggaaaaaaagcttcctatctttacatcttcaaacaggtaaggcatagcgctatataaagcttcaaaaatactggttaagacattcactacaatcgaatttcctgcctgcttatatgcctggctgttactgatgcccgcttccaggaccttctggtaatcttcatcatcaaaacccatcagcctgaagcactctaatggtgtaagccgcctgatacgaaggattgattccagcctgcacagggaatttccctgcgcagtgattgtcgggcagatggtcccatgtccctgtacccggccccgttttccggcagcattcggataggcgatatttacaactccctctgccatacattcctcgtagccttttacggtgtcctgccgcaccagaatgatgttatccttctgtacggaggtaatcgcatagctgcaccaaggcttatcctttagttccaggtgctgttcgactcttccctcttcattatatcttccacggattgcccccacttgcaaaatctttgtctggtcgtggctcgcaagctgggtattggcagttcccatccctgatagtataacactctgttgggaatttccaatacttccgaccacggctattttatttcttccggcaccgcttgccagcaaagtagggctggaaccgattgcagagtataccctgccagtctggggatcgccaagatacccctgaacctgtccaactttatacagtttattttcccactgtttcagttcctcttccccaggcatatacagaagcgctttccgctccttcatgtctgtaatcagtttctgcactttatcatctgacagataatatttctcatctacctcatcttcaaggatatccatcagccgcctcccgttttccattggctctgggaatacgaattttccattatcacattcctttttaatcaggacgaggtatacccgttcccggttttgcggaatcccataatttttcgcgttcaatatcttccaataggtgttgtatccatattcctgcaattcctgctcaaatagacggaatgtgctgtttagaaaccttgcctgaacaatattttttacattctcataaattccaaacatcggctttacttcccggataacccgaagccactctacaaagagagaggaccttgttttatccagattctttgagccgcatttttcacaaaaatcccgtttgctccaatgtacctgcagcgggtttacctcatgcccgcaatctctgcacctccagacggaaccggccagcttcccacttagggagaaatcctgacacgggcttccaccgcagataaagttgaaataaggtagctttttctcatcaactttcgtaatatccccaaggttggcactctcgtcaaccccatgtatggcgcaataactttttactgcatatttgtcaaactcacaaaaatttattaatttataatccaattcccttcttagagggtgtagctacacattttacccgggattacctcttacctcctttcaaatgtttgaatgtaatcagtttccgaataagttacgagctactggtacaaattaaatttctatgactgctgaatttttattggattgggcttaaccaccccctttcaaagatttgccttcatcttatcttgccttatgtctcgtttttttctctatctgtgccgccggttggattgcaaggctttcggcatcaaactggaacaccatattagagacctggacagggaacacttctgctcttttatccatctcattgctcttttttactatttcctgcaaagtttccaaactgtgtcctgatattggacagacaaggattttatcatttgataacggcataacatacaggtcatcatccaaacgccttgagatttcactcaaaccctcgggatagaacatgattgcaatcccattctcgctgtacaccccgtaatagtcttttgtgtctggaagcgccccgcttaatgcccctaatgtatgagccagaacagctctgctcgtatccaaaaccgtctgaaagcgttcattcatatcgaaatatttgactttatcaaataattcctgtaccgtaagtccccactgctttaaatgttcattttggacaggtcttttataatccagaggccactgttcatcctcgtcatagacttcatcaaagaactgaaaatatacagccatatccccaacaggcagatatggtatatcattcccttccagcttttcggctgccttttcaaaattagccgcccaaatcgtaacattttctaactgctcaatcgtttcaatagcacgctttttttcaaaataatcgcagatactgcttacctgggccgttaattcgccttctttccactgtctatataagctatggattgacaatgactggctacacacaggcggctgcataagttcaagggctatttcctcattgtccgtaccttctgctattactatcaatctctgatgctcttcatcaatgtgacgcccaagttctgtaatcagtccctgtttatattcttcatatgtcattcatttacacccttcaaccattcgcgtatggtcagcaatttgttcttgttctccgatggtgaatagtggaaaccatgacttgatatggcatacccagccaagctgtgtcgaacctgacggttcccattcttgtggacatcttcaatggaaaatgctggtgccagtgctcccatagtatcaggcaggatataagcctccctctctgaatatggcaaaatataaaagctatccggcatcaggcggctaagttcctgtaaggtatcccagtataatacacttgccgctcctccaggtcccgtgaccacataaccaaggctatcctctgcctctccattgttcagacagcacgaaataccttccagcacattttcaatcttctcacacaacggatagattttgctctccatggataccagcgaatgttccagtacaaaattatgaaaatcactttttctcattttccaggatgccagatgtttattggttacttctgcctgataataacgcccgtctcccagcggtgcgtgaaacatatagtagagcaccatgtcccccataacctggtaaggcatatcattctttttcagggcttccaggtcacttctatggtttgcggcatatactgccacatattccggctgttccaactggcctactgcaatacgcagatcttccgcttccgcatcagagaacacttccatcgcccggtctgccaattcctcttcccaggtgtcaaacatctccgctctcaaaaaagcctcccttaccggaatgacggggcagtaccgcccctcctgctcaaataaaattgtgattccctcggtcgggagacccctagccaccgttctaacttccccgcgaattgcggaatcctcaaaagcggaacgaatacattgctggtaagcatctgaaaactgtttatataatttgaggttcatattcttatctcctttatgattaaatgaaaaaagcaggttcttttctgaatcgctctgaaaagtcacctgctatggtttttattcacttttggcttctgccgcatcctttgacttgttttacggatctcatctgttttccggctataaacataaatataatcggataaatctttttccctctgctgaaaaccattttgtttagagtcgtagagggtttcctgaatccattttcttccgtccctgtttttatttgataatgccacgcattgattgatacttgtaggaaatagtatcatatcgccacccagtttatctgacagctcgtgtactttttctttgtataaaaaagcagaagcaccccagtaaaagctctctgttgtcataatgtagatatccttcttttccggttctgtcccaaacggttccacggaaacagccctttgattttccggattatcaagcgaccactgataaagggtatcaaaatccattccaaactcattcagcatttcacttgtcactcttaaattaaggtgcatatcttcaagcaaacaatctgttgaatgataaataatcctcaatacaatggcaaggtccccgtctccatatagcttatgtgggaaattgtccaatacctcttgatttcttttcgcgttcatcaatgtcggaactactagatttggcgataacacccccatctctttaaatgcggctttggtgatccggtcatcccgcaataaaaactctagcgaattcctgactaccagccacaggggttctcccaactgtgtatgacggttatatgctacaaaaggaaatatttctgagcctttctctgggctgccctgtaaactgatcacacagccatccgaaatatggtcaggcagcaccaccttccaccctaatcccatcttttgtaaattattgtttaattcatatacaaaggtttcataaaattcccttttctctatgattgaatatctatcgtttctcaaaccctccccctatctgcctcgttttttcgtttcttttaactggctgggagtaatcatacgaaactgtgcggtttcacaattatagtggtatagattcccagacaggggctttatacttccagtgattacctctttactactgtgtagtgcattagatatataatctatgcccttttggtctaaaagcggcattgccaaaaaatggtcaacgctcataggaaccaataagatatcatcccccatagtttctgcaagttcatacattctggttttgtaaagaatacctgcagcgcctaaatgttgaccagtattcgttaccacatagaagggaggtaaatcctctactgtttcatcgggtgatataatatctatcatcttgtgcaactctatcatctgtacagactcaacattcctcggattatccagggccatttgataaagttcatcatacctcagcccccatccctgtaagatatcgtctgttaccacaaggttgagattgataccgcccagggactgatatgcaatttgaagtataactgctaaatcttcaaaccttgaatatggaacggttttcaatagttcctcattttcctctgtgttcataaaagtgggaattaccatatctgcatgaaaaagccccatatccatcagtgcacattttgtgctctcatcatcaaagaaatcctgtgttgctttccgtgcagcgactccccagggcatcccctgcaaaaactcctggtaataatcgtgaactttaatcggaggaaaatcatgccctccaccatggattaccaccaaaacttcttctctgccgcctgtgttctcatacttagcccgccatggaacacccagcatttttaaattatagttgacttcatgggtaaaaaactggatgaattcttcatattccatctttgtctgtcctccttgagattttatctgctttgctttttaccgaccagtgttttctcatgattcatagttgtctccaatttctgatcaatgacagcctgtaattgttctataccacccttgagcctgtaaaacttcccctctgtatacgaataaacctgcctggacaaaaataaccgcgcgtccgtatcctccgtatactcccggatttttctttgtacccacatatcctgtatacggctttccggtaatatggccgcttttcgttctgaatacggtacgattatgacccgctcatgaaaagcctcttcaaattgacgcagcacttcggggtaaagtatcgccccggcaccgttcaatccatacagctcatatggcgcattgtagatatcttctgctcttgcaatcacaggtatatggccaaaatcatatggttgaaggctttccacccagtcataagcacaggcaccgattttctgtgcctcgcattgcctaacaatattgaataattcttcggctgaaaacttccattttaggagatggtcttttgttacaatactttccattgtaccgccgaaaggcagctcataatcaaacctgaaatatactgccatatcacctactgccaaatatggtatacccttaccccgcaggatttctttgcttttctcaaagtttgttacacaggctaaaacactttctatgcattccacctgttctctttgtactgtaccaaactcccggaaacaatccaatgtatccttcacaatagaaaacattggtctagcatttttgcaataatccgaataaatttcctgaaggtctatgcaatgacagattttatcgcctaaatccagggttgccttttccagcgataacccttcccctatcacgaccggtctgatggaataaccatgctggtctaaaagttctgctattttttgtagataagcaaccttaaattggtcatagtttattaagttcatcaatccactaacccacctacctatctcaatttttgtttctcaattttcggaggaactgcatgaatcaggtttctgctttccagatcgtatttaaaaacccgctcagatagtttatggcgtatttcccctgtttcttctttcattatattctcactggtcaggctctcatataagtctgacagattcccaacactttgcgcatggacataagcaccaaaggcatcattgggaacaatcagcatctcgtcccctaatttatcatacaccagttccataactttcggatagaagattgcaccaaagccattcacaccatagacattgtagacttgcttcagttccaatggcacaccatccgccggcctaaaaaggattgttttatcattttcatatctgtttgtaagtgaatcgtacatatttacgatacccactcctatttcatttgcatccttgtatctgactttctcaaaaagttcctccacaccgattccccatttttccaaatgctcttttgtaacatctccgcagtacgatctctcccctctttcaatacagaattggaaagtgaccgccatatcctgatatggcatatatgcaatgtttccctccaccagtttatcctcatattctgccaaattcataggatatataagtacatgctctatctgctcaaattgttcgcgcggtatccactcatccccatcaaatatacccagaatctgcgtgaccgcctcgtctaactcgttgttctcagcaacatagcagttaagatacaccaattccatcggaatactggggcaaactaactcccctccacctttcagcataatggcttcaaatggcgtgccttcagctatcagcttcagttcctcccctctgtctctttcttgtagctggtcttgaaattcatcaataaaatcctctcgtaattcgtcatatgcttcgttctcactataataatacatctatctccttcccttctggccgtctgcgcttctcccgattaaagcggttttcatttcactctatgcttttcaatggtatgttccattgccgggaccaggtttttcctgccggtatcgtacttaaatatcttcccagaaagtacaaggtgcctatcgccagtcaccagtttcacacgattgtcctcctgtaattcttcttgcagttttgcagcactcataatatccggtgtctgaatataagccgtataggtttcttcaggtacaatcagcacttcactgcccattttttttactacctgctccatcacttttggataaagggcagcaccaaagccattgacgccatacaaagcagcctgctgtgaatcctctgatttttttcccacctgctctatggttttaatttcgccccaaatttgctccaggtctttataccttactttttcaaagagttcctttgcatttatcccctgcctattcagccattcccttgtaacatccctgcgatacgacctctcattgtcctcaatgcagaattgataagtgatcgccatatcttcgaagggaaaatatgcaatatcattttcttccagcttatccctgcaatgtgatagatttaccggaaacactattacatgttccagttgttccagccgctccggggatatccattctgcctcatcctgaatctccaagatagtagatacggcctcatcaatctctcgaatggcaaaaatatagcaatttctgtacaccagttccatagagatactggtacataataaaggtccattccctttgtatgtaaaggattcaaaaggagtaccttccgccactatttccaacttctccccatttcctctgcgttctagctgtgccttatattctttaatgaaatcctcccggacttcctcatatgcatggttttcatcatattcgcgcattttggttctcctcttcgtctatttaccatttcctgcatctgtagactcccgtaccgactcttagaccagggtttttttcaccaatgaagactggtgcaccgtcagggttttactcttgagactataatacaaaaccgactctgacaacggatggcttacaaatccctttaaggatttttttctttcgagacgcatctgaaggtcagcaggtgtatactggtcggcggcatatatagcggtttcctctgctgttactggaagcaggtacagatccgtgttgaccatttctgcaaattcatccagaatattcctataaagcatgcctgccgcgcctcccggacctgtcagccgccaggcacttgcgcgttcatttgtaatctttcctctcccaagcgtaaagcctgcctccaagccttcccgtataacggctgcaaccggttcaatctgcacactatactgggagaaagcattgtctgacacgcacgcatgcagttgatctacatgcattccccaccgctgtaagtcctcttcatctacgggcatggtgtatacaagtttttcactttcctctttcacacggaaccgataaaagatacacatatctcccagtctggtatacggcagctccaattcttccagcctcatctggtatttgtttgcattcactgcatggaactctacaaacaatggattcttgaccgtatccatcttcaatcggatacctccggtttccgccgtctgaaattcctgcagtgtctccgaagccaatatcctgactggcagcatttcatactggcttctcaaaaacagttcctctatgctgaccatagggcagtacctatccttgaaagtcattgtgattgattcacctggtagtccttccataaccaagttcaacgctcctaacgttttgcttttctccatcaggtcaatgaactgatagagaaactcttctttgaaattaaaataatccatactatctccttgcttttatgaaattatccgattgcctgtttccggtccagattgctattcctgttcaaatattgaatcactgccttttttctttctgcaacaagaaattcattccaatctttcccatatggcgggaaccggactttaacgtgatatcccatctctatatatttcttgcgtataagtgccgctgctttccggcctgccttatcattatcaagatacaggcttattcgtttaatctgtggattttctagcaggaaccggtccaatgccccgtcccaggttgaccctaatgccaacttgtttgactgcccatcacgcttataatccatataagacatcaggtcaatggctgcctcaaataccttgacttctttatttttcttgtttcttacattgaaaccataggttttatcgttgttctccacgtcccctttaaacgggtttccataattatccaccgttcccctcatactggcaaaccgtgctgtaccaaaggaatccctgccaataaaaaccacgttatgatatctgcgtgtttcataaatcagcttttttttaacgaaccagtcaactacttctttgctcaggcagcgcgtttttaacagataggcatataacctccgataattgtcgtttggttcgggaagcacaaactcccctttcccttcttgttctttattttgctcttcctttcttctctcgtggtttttcctgcttgtatcatctttaaatgatttatcctcataccgataaccggcctcgttcaacaaatagataaccgcctcacgaaaatccatatagcaaaattgtctcagaaactcaatgttatccccgttgtgaccgtcctggccctcgggtacggaaaaacgcagccagctcctacgatttttaatccttatagaatcatgttctttcaatgtatagtaactgcctacccgcttcaccgtgaagccctgcctttcagcaatagacaccaggtccacgcttctggctatctctaattcttcatctgtaaacttcatagcaccacctcctgaatcagagtttaaaatttcatgtcaaaataactgctgatttccggaaagtctctttcatactcctccagatacgttctgcaggcgctcccttcttttgacaagtggcaaaattcacggaagctcatctgcttatacatctggggctggttacaccacctggacaggtttacatacattccccggtaaggtgattcctgatatttctcataccgcatgatatatggatacgcacgcacccccattagaatccggatacgctcaaatgcctgtaagatatcctgtttccagaaagtccagtcatatcttccatctgcatcaaacccagttaatacatagaacttgatcctttttgattcctggaatattgggtttatgatcttcatcttttctatgactgtttctttatccttgatattgtcaaaggcaaataataagtcgccatccaatctacaagatgccagttccctggatttttgcctggtaatcagcctgatatccagtccttgccggaactggaccggacggccggtttcccgtagttgtcccaataatgcactccactccccacatgccagaaaattatcatccagcagacagatcttctttttctgtggattgtaaaattcgtacactgggcttgcaggaacggataccgttttatttttgttcacacaaaaagggcattgcctaaagcagccccttgttaaaaacccaatagaataatcccgataatacttatacttcttactcttttttccttcttctcccttacctttaagccaatccgcatacagactgtaatccggcatggcatgctctatttcgtagggcagctcgggagcctggtctaaataaaacccagtacctccatattctacattctccatctttaagacttccggcggatacctcgtagccgtaaagacctttgacagatataccttatcaaactcattgaagcctgaatactccgtcagcaaatgtatctgatcccccatctgcttatggaatccgctgatcttcatgcatgccagattcggcatgcggtgcctgttcttatccaataaatcagcatctataattccgattctcgactctcatcaccttctttacacaaatttttcatccatctttgctttttacattgcggtgctgttgtatgtctgcgcctggcaggtgtatcccaggagccgccccctgcaatctctttctcacattcccaccctgccgcttttaaggaagcaccggattcagagataaggatataagtgataatccgctcatatcccatctcttttgcaatccgggctacccgcccgtataggaagctacaggcattggctgtaccgtctgtgcagcaacgcgttacttccagcgtttttccatcgtctaaatgcctggatactggcctgccgcactgtatcacgccacatattctgccatgctcagtacatgcgacacggaatttgtcccggtatacagggctatgatgcctatgattctgcgcgacatattcatttgccgcctttaactcaatcggtactgctttcattcacttttttatataaattagttccggttggaacgtaaacctcctgttgttgatttattgttttagtctggtcccatgtccataaaatccgcgaggcacaactgtccctctacatttttatcctccatccaccaccggaacacgtcctctccgttcttccacttagtaggtttccccgccgcatggattgccactaacattttatcaaacgcccggatataagctgccttatactttgggaagtcagcaaactctttgtagcggttttttccagccatcgggcaccctacacagccaactcttttataacccatatcataaagcggattataaggcatatggttggaacggatataatcccagatgtctttatgtgtccagtcaatgattgggttggacactaccctgccacggattgcacaccgctcaataaccagccgcttatcatcgttgtcgttcatcagagtaatcctattctcgacttttggggcagccgcttctaactgtccccttttggaccgtttggtgctttcgtcccagcgcacacctgttgataccagtctgtccggtgttgtgttctcttttaggatttcacaacagtaacgctgcatcctggtgggcggcatcttctttttgacaatcaactgccacatgctcagtggcggcatatggataatacatgggattcccttttcttttaaacctcgaaatttctccctgatatagtacaccgtatcgggagcatcgactgttgtatgagaattgtgggcctcaaattcaactcctgaccggataaacaaatccagaagtacgtcagaatccttgcccccactgtaagtacagattatgggggcatcatagtacctctttgacatttcacttgctaatttaatccgttcaatgctcttcgtctctaaatccaataagcgtcgaagagactatcgttttacgtggccacaacttcttatccctcctttttgcatttctatttagatttttaccagaggaatctatgaaacctctctacttgaagggattctgtttccttaatctgtcctatattatggacatatccaggccctggtcatctgcgacagctgggactgtttctaacagttactttttctttccatggctttatttcctggaccttatggattctttcacatatatcagcgattctttgatactctgcgtccgtcttatccagtattgcaagcaattccttaaaatactcggacgcttctttacagccctttggttcggacagccattgatatgtctcatgtatccggtcctgcggtgttttttttacttcatcttcgtccgtaagcccaaatggtccaaggtccatcacaaggctgcttacatcctctgccaatcgcaggatatcttccattgcttctttctccatgtgtttatcctttctcacgattacagattggatttctttgttttaccgcgctgtgctactatctttctaatctcctggcgcattttctttgtgttattactgggtaaagcaaatattgccgcctcctccactgtcagattatcgtacagaaacgccctttttatggtccgcatctggtaacaatcaaattcttctttcgcataaaatgccacctgttcataggcaagcccatagcgaaaacccgacaggatttcttcaatctgctcttcatcaaaccggttatctgttgccagttccatttcctgtatgcttctgccagtataaaacccataaaacactaaatccatttgtctgtaatcgtgttttccatctgccacaatctgaattttctggatttccagtttccgttccagtgccccagctattgacctgatttcctccgggccgtctgaatcatgtacaagaccgataaggttgtcaaaatttacacccatcaaatacgctttgcgcaaagcatttattttatttctatatcctccaacctccataatcttctttaccgtttcatagggtatctgatcagaatttaacgcttcctccgctagatacaggttgtcttttgacaagaagatttcatttttcagggtatccaaagttttgtttttatcgtacatgccacttcattccttcctaataacaaaaagaggaagatctctgcgtctccctctttggtaactgtttatttatttttactttattttttaatctagtctctgtggtgcgatatgccagtccgtccacaaattaccgctgattgtcagattatcggtcaggtttagtgataacattcctgctggtgtccaggcatctattaaccatgtatagggtgtatatttgccatctggcatccatatcggagtgaaatgtgtcctccgcttaaatgtactgtattgattttttttgaactcaaattcggaatgatacccacccgacatccgctccaataaacgccagtatttcttgtattgaaactccggaaaatacgtcacggcattttgggctccagtcacggcactggactgattcgtgctcacagaactgttcacatattcgttaaatccgtatccgctttttaatgttttgccatgggccgtaggggatttatcatctggctggacgcgcattgttgcgttcaaacttgcatgatatctatcaatattgaacttccaccagccatgatcacaccagtatccatcatcatcatcgtcaccactatgccatacccagtaagaataccagtatggtcgccaaatactccaatcagcggacgtttgctgactctttgatggaactgccggcctcgcataactgtcattacggtcatctgcaactggattcggcggtggattcttgtccaggtttactatcttaacccgtatagtccctttgtctgtacggccaccacctcttactgttactggaatttccatagtctgctctgtagatggtgttgtccaccgaacccaggcaagctgacttcctccctcgggataatatacgctgtccaccttataatttctcccttgtattttaaatgtcacagataccttatggtccggatcactttgaccgccactcacgcggatactggtgataacctccgtgttagtgcggtattcataatcaaaagtcgtaacctccggtgatggttctggcaactccccattaaaacgtatgattccaagtcccaacgaagttttgatttcctgatgtgaacgcaatccggtagttggaccgttccacgcaggatatcctaaatcagatttttcgagaaacattgcaaggggcagattttgaaaggtaactgaacgtaaccaggaatataccaccccgcctgcaacctcatcatataaagccgcttccgttgctgtcatagcaactcttactccctgcaatgtcacatacgcaatcggctctatcataattctgtactcgccgctgataagtatatcaaaatctattcccatataacctgctatcccacgtatcgtctgctcgtccgtaaagtaccgctttatttccgcaatacttgatggtcccagactttgtgaacttataattataggaagtctctgtgctggtcttatgtactggtatcttgaaccggatataccaattccatgacctgatgtataagacatcttgctcacctttccaaaatgaagcctaatatcagatgggcttttattggtaaggtcaataggcgtgcctactactttatggtcacttgtacttatcaccgatacacgtaccccttcatcacctggggaccaaaaattttgcgaagaaccttgtcccatgctgccgcctccgccgtccacattaccttcccctgccgcatacgctggaaccgacatgatcaaaaaacacaggctgaacagtacaatccttgtcagccaacttattctgcttttcaaattcccaaatgttctcctttccaatgaaaaagcacagccataaatagctgtgccgaacgataaaatttatatctttgatttctctctatgcttagcaggagggcgctacaattcatagcctttctgtcatgcatctatttaaccaacctattgataattaatccattatcccaattttattaccgttttcataaatgttactgtcttcaatgccttccccttccccaatgtcatcaatccatccaaagcctggggcatatatttttccttcctgtgactcaccttctggtgcggctccaggaaccgtgtctgtctccggctgttttacttcatcatggttttccggaaccggcgtgccctgcacgctctccccatctggtttctgattaggattttttaatacttctggatctggttcttccggtttagtcactctgggctgaatattctgtacaggctgcccgttgtccttatttccctctttttcctcctctgattctttctgctcctccgtagtctccggttctttcttcgattcctcttctttactttcagtctcttttgacttcttgtctaattcggactttttgatttccggtttcacttctatttctgtagactggctctctgctaatttatcctttgtttttgctggctttctgaaattacttgcaatcatcactgcaagaataacacaacacaccacgcaacccgcaataatcataccttttttcactttatcattcatatagttctccttcctggttcacattctgtcgcatcaaacatactacatttttccaattctgtctattgaattctaaaacacttctatatatccagcctgcacttttagcctgattttcatttcaggtagacgttttcccgcaaactggaccggtacttttaatgttacgattgcatcaatttcaaatctctgttcattttccggtgttccaggtgcaagcggcgcattacgtgcagtaacacttaaatccgatatgctatattccagaaccccacctgtatattttacatgccgcccggattcaacttttgttccaaggattttatccatttttgacagcacatttcctttatctacactatacttaaaacctccattattgggctgatatcctccactgtatccttccctgacaccgtgataaacgtttgcataattatcatttacagttatcatgatagcctcctgtgccgcgtcccttacgccattggctatgatctttagccgataaaactccaaaaatccgcacattattaacatcaataccaatgtaaccgcaatcacaaatgggaaagaggaaccacgcctatcttttaaacagcaaatcaggcgcttcatttatgatatacctcactctttcctgtagcactagcccttaaggtaattggaaaggaaccaaaattcccaaataacccaaggtcccgctgcaacgtcaattttacagtaatctcctgatttagttggatattacccttttttgaccactcaactttaggatttagtccggtcctttctcgtaatacctgttcccgcctagtggtctcagttccgactctgccactcatttcagcctcacggcacaattccacagcaaatgtatctaactgattcttagccaaaaaaaccggaaatacgctgaccgccaatgcaatcaccagcatggcacacaataccagtacgcatatgtctatatatccctctccacgattagtttttaatatttttttcaagttccttgacctcctttcatttggagctagaacatacctcctaatgacttaatgatttcaaacacgataatcgcaaggtaagtcaataagaagcacataagcatgagaaacgaaaaaaccctgattttaggcggtattttctgggcctcactttttaatttctgtaattcaagctgtttaaaatcatgagcaagcatctggaaatataccacgctgttatctccacgcaaaaccccaatcagtcctctgacaacatcagacaacattggagagtttaaccgtgcttcaaatcgagtaagtgccgcctcataactggaggatctcatgtctgccacaagtacacctagctcctccccaaattccgcaccggcattttttctaaaattctctaccattgaaagcacatcacggttattctgcagctcctgttcaagattagcaacaaaacgtggcagttcgtcttcaattgactttcttttcgtctttaacatctcgtctgcgcgctgaatttccttaaagtaaaccatgacagcaagaaacacaataacaggtgttaggagcggaaaaagaaacaaacacggaataatgccagccatcagtaaaccagcttttgtaagtgcatacgcctgatatacttccggtgtcatattaatccctgttgctttcagcacatttttcattcggcttttccgatattcgtccattcggattacatgagacaatctcatggctccttgcagtaaaaacgtatctaacgccgccgacccttttttactatttcttcccctgtccagtaatgccttttctgtcttcatatatggcatttttaacaaatccgctgccaggaagaacattcccagaaagagaaatcctccaaataataacagtaataacactgacatctccctacctcctgtattctatcggttttgtcagcctgacaacgaccgcagtagagacaaagatgattgccgcagtaatggcaagtatcacctgtcccattggtgtgtgcatcaaagtgtcataccagctcttgttgagaaaataaagcagcgggatattaccaatcacaaagattgccatcgtgataaattctttcctcggctccacaatcaaatattccagttcagcattgacgatacggatatcgcttaattttgttacgattggtgtcaatgttgtcttcaaactccgatcatactgacaatcacacagggcatcgcaccattcgcggaatacatcattatcaattttctccctcaactcctttagtgcttcatgaacatccggatttactaagttgatccgcacaataaaatcctggaataccctctggactggcggattcaaatactgaatattttcctctatcgcagttagaatgtcctccgtccgcagatagcccgtcgtaataacgcttaatgctgtctccagctctgcggctacattttttttgtaattactggctgacagaattacataccaaaaagggaagaacataaatccaacagccatcaccggagccagaaaaaaatttccaatcatgatggcaaccgaggcccccacagcaaacaacaccagggcggcagcacaaataaccgaaaattgcttttccctacccgtcattttaagtacctgctgtgcctcaatgattgcctttttcagaaatcttgcttttttcctttttgttactgtatggatttcattccgaatattctcaggttcttttgccagaaagccgaacagtccatctgtaaattctattggtcgaatccccaaaagaagaaatccacccactatcataccaaggcatgcaagaagctgtatacttgtcaagattcctctcctccctctccctttgaacggaaccggttaagtgtctccattggcatcccattctccagcaaacgcttataaagcccatccgaaatggaattcattaccctgtgtttcccattaaccacaaaataatctccttccaactggttctccatgatctcgtactgatacagtggacgatatctccgtgtaccgtcaggctttatctcgcattccataatctccatgattaccctctgccggttttccaactgcttacaaaagactatgatagggtatgcttcggtcacatatcccatcaatgtctcgtccgacatatccacggcacgcttacacaaggacaccatacggcggtatgtagcctcacacgaattggaatggatggttgtaaccaccgccacaccagttcttgcagcttcctgggcggcgtttgcttccgcccctctcatttctccgaccaccagaatatcaggattaaatcgaagcgcaatatccaaaagggcaatctggtcaattcgctgccggtcattctcactgtctcttgtaagagtgtggacaacggaatttaacacttttccactttcctcccttattagatcaagttcacggctaccattttcaatagtaaaaattcttttccggtcagggattgtagtaagcaaccagccggccaccgttgtttttccggaacttgtagcacctgcaacacacaccgaaattccataccgaatacattcactcaaaaagtctaacatctctcccgtggcagttccaccagaaataaaatcctcctttttcatactctggggatttacgattcggattgaagcggcaagacctacctcttcatctacaactggagtttttaacaccgctatacggatatttttagccagtgttccagtcaccacaggacttgcatcatcaaggatagttcctgaaacatggagcatcctgcggatcacattaatagcatgagaagggctgtcaaaatgttcttccaacttttcagtcccaccaccgctgtactggatctcaatatccttccagctattaatgtctatttcttccactccctctccaaaaatgtactttgttagaaaagaaaactccgccatttccgtgtataggttgtcaacaagttcctgatttgacattccctgaactgcaacccggttttcctgaacatatttagtaatgtaacgcttcatctgcctttttacatcatcattatttccatcagtcaaaagggagctgtaacggctggcaatgtgttcctgtacctcctgtagcaccgttgcaaaatctttcccctccacggctgcaaaaaagaggtcatctgcactcttactcaccacttctaccggctctcttgcaaccggctccactggggctgcctgtgttggcataagttcctgcatccgcgaaccccactctgaattttttccctcattaaatactcctcgcgtctttctttcccctaacatccatatacctccttaacaatcttatctatttcatttttaaaaccacggctttttttcccctccagaccaatcaacaaattcccagccatcccctgttccgtaacttcggatgcagacggaatctgaaaacttacttttccaagcacctgttccatatggttaatggcttcctgcccctttatgttgttgatcgtttttaaatgcctctctattctccattttggttcctgaagtaacggtaactgacttgccaggtaactgatagatttaaggtcgcaatttactatctgcagaacagcatctgcttccattagagaaactgccgataaaatatcgttagatatataactgctacagtcaataataatgtatgaggacaattcccgcagccctgtaagaaattccaaagcctgttccgcttcatagggggcatagctgtattcattttcccctcttaacatgccaagcattgccagatactttatttttttgtggacaatacagttttcttctataagcccttttgtaacatgtggcgctgccagtacattgccaagggaccatatgttttctaactcgtccattggacagatacaaggcatcatgggtaaagtcatatcggacagcacaagaattacatttttcttcttttccgctaagtgttttgcaatcttcacagaaaccgtagtctttccgcatccagggctaccccagacagccagtatctgggcctgatgttttcccacctcatgcacttcctcgctctcaggctgatttgcgcgctttttgattttaaagttcagcatttattctgcactcccttctatctgttcctcgggctgtccagtttccgcttccgccgcctccgtttccggcgggtaaagttcctgcaaagcatgttcctgctctgtaataaactttgctgcattttcttttgttcccctgtatacaagagatatgtgcaggttcccgtccttctccatcatggcgagtatcctgctctgttccggtgttgccaagagtgtcaccgtactgggcagttccttttcctccgggtcttcttctcctgtattggcatcgtagccactgcctgcagttacagcaataacttcgacatatttgagttcgggaggaatcactgtttcgccttgcttctggtagtccggtgcaatcacagatacaatatcaccagatttgagttttccggataaccccgttgcaaaagatttgaccgacacggatattgcctgtttctctcctgataaattatataagtaggcattctccgcagccggttcgtctgcgaccttgctattaatgatataatcgcctggagccatatctgcagatgcatatttcccaatgacattttctttatttttcatgacttcagacggcagatttaaacttcccacctcaacagtcctgaccatatcgccagtgattttatccccgatttttatatcctttaccacccgcacgatttctacctttttactgacctctttattaaataaaggggtaactccgaagcaaatgagcagtgataccacaatgcatattactccaagcacggtacggctttttaatattttcatacttattatccattcctttcaatcaaatcaaaattatcgttttaaatgcggcagggaatacctgccgccgtgattacctcactaagtatctctttttcctccggcatctgtaaaatgccaggacagcacccacaaaggtaattggagccgctacacaaatacaataaaatgcttttcttttcattccatcctcctatccaatcaaataccccgctgcacacccagccgataaaaagggtactaacggcactgcgataacctgggttttcttacatattttcaaaaacacagaataagcaagtaccagtaataatcccaaaatagttgcaaaaatccctgctggaagtcccaggacaagtcctgcggctgccatcagtttgatatcaccgccccccattcctccgcaaaaaactgctgcaagaagaaatgggagtgcgctgaaaatcccccataactgttctggacgaaaagaaatagcggcggttaatgcaattagcatacataacagatccggcacgattctcttctttaagtccgtgacagatgccagcaaaagcaacagcaaaaatacaattgtttgaactgcctttctatccagcatagttaaacatttcagtaatacgccgtgttaatgttggcagcactgtatcaccaaacagtgcatacagccctgccagaagcagcgctccaatcacaacagccattaaaattttgatggccgtatcaacgaacccctccgccttattgttgttaatagccgcttttaccttcattaccttagcgatcagatagtttctcatctttgttttcatttacatacctcctactggttttctaatttaattgattttcaaaaataaaaacggactgaagatcagcccattccatgtgtttttcttaatacccgcgccatcatactctcagcggactgccctgttatttttactcttgatcggggcattaacaaattcctgcaagccatgaccgcacggtacgtactgcctgcggttttcttcacatagaaaaatatcatatttcttgccgccggcagctttataaaaagcttcataatcatatgcatattttctccatggttcatcagtggatgtcatccctagttcccggtcatcccgcagtttgcatgcgcgttccataaaatcgccatctttatcctcaaatgtccttaatggataaaaatgatatccaccatactcaaaactttttttatccaacggtttccccttttctgctaaagttcagtaacccactcaagtcatttcccttacgatttaggttcgtcacgaatccggttcatcttcacgcccttcctgcctgtcagcatatatttaaaggaactttcatttccacttctttatttcatcatccgttatgtaatcgcagattacagcaatcatccttatttggattgaagttatctctccaatactcataatgttctgttacatcttcgcaaactgttatctccggtatcctgatcttcttgatgatttccatctttttttccagtggtaagtggcagtatcctccttgttttaacctgtacccactgaaatcaacatcgtgcagccagctcttgatccagctattgacacgcaaaaattccacaacacagcgattgatccctaatgaatttaggctgtcaaagtccatgaaatcctcaatcaaggggcttaaccggattgacacatcatatcccgcagattgcaatttttttattgcctctactctttttgatgggatacttgctttttcataggtcaaagccttgttatcatctaaagtcgtgaccgtgatttgtatatgggccagatccttgtccaaaatttccagatattcgggctgtgcgatcaaatgggattttgttacaatcagatatccaacaccacaccggttcatttcacagattgtctcataagtcacatgatgttccgcttcaaaaggctgaaagcagtctgtcattccacccatgcgcaggatggttcccggaggtatcttccgaatcttcctcttaatcttatcaatatctgcgatgctcggcgctgatgggttccaaaatccacgaaaagacagaagtgaccgtgcataacaataatcacaatcgtgctgacagccacatccatacgtatccagtcgtacactgtatttgcatttgtctccttcgttacctcttacttttttgtaaaaactcttatattcgcttcctattcctcctcttcttttcaattggttggtcaacttattaatctttggaaatggttccctttattgcggagtgtagtaccgccctacaatctcctggtaaagcatccagacatgttctttacactaccccgcttcatttatttttcattataagtaccaagaaaagcgcaaaaaaaagcaggctgacgaatcagcctaccacagtgatactcattattcactattactttaacatttcttccatatccgctaaatcgggaagaatcaactggcattcgcaatcaccataaattgcttctccacataccggacattcctctatatcacagcccaaatggtgaaaactcccaaatggcgcaaaacaatctgggcagatatcatcttcgccaaatacatcctcaaaccttttctctgcaccaaaaatgatacgcgggtaactctttccattacaattgcatatccctattttacaacccacatgttccagcatttctccgccacaaattttacaaatagccataattgtactctccttgacttattaggaaggggttcccatgtctactaaaagcatgaaaatatgaaatacaaataaaaacatacagcctatcactttgacactaaatgatacaacttttaatattgcatacgcaattccaagtaataattttcctataaattttatcatagcacataatatggtcatattcaatcttctccttcgtcttcaaatccagtgaatgaactatagaaattaagcagattaaaatccttttctgtcgcctggttcgccgtctccgctgatcgttcactctcactttggggttcctgttcctcttttgctttcgtgtcacttccagtaactgcaggaatagtagtcgtctgcactgatctcagtacgtcttccaatgcacgttttgtcagttcacggaagtattcctcttgctctcttatgtttgagaggatactttccaatttctcatattcagccttctgcttcagatactctgaataatagattaccgcctcggcaatatagtcattttgagaagtaaacagctcccggttgtactcttccagacaggtaagtgcctggaaatgtaccgggttatttttataaagccgaagcgttgtaacatatttatcgtccatttatggcctccttaaccggccatattctgcctggccttccatatgctctttaaagtttcttcatatcctcttgcatttgcatgtatatccggaatacagattacgtccttaccctcgttatcaccaaaattctgcatgattgcggctcctccacccataaagattattttttccaaatgcagattgtatccgtgcttttttatcaagctatagatgtattccgtatattggttcaatgcctttcggattacacgaagataggcttcgtcacccgcatatgtacctgtccgcattatcgtttcaatgatatatggtttggctttttccccaaactcagccattaatgcctcatttacattggatatacactttattgtaccattattatctataataggctgtgctccactgggtcgcatattttctattggaactccatcaacggttcctcctcctatatctaccagaaggcaggattttccctgtgtctctgccaatatatctgtgattgctgcaaacccctgcatatatacgctcacgccttccagaaagacattgaacccttctccctgataacgaaaagataactccctttccctgcccaagtatttcctgaatgctttcatttgcgattcataccacctcggtggtaatcctgtagccagcctgaccgccgcctgattctttcctctggctttcaattcagcggcaagtgatgccaatgtgagaatgtagtaatcatcgtccactgttttatcaacttttgtatccacatcttccctactgccaccgattgagtaatacttacctttaaactccaaaatctgatttagattactgggcttcaccttattctgtgttactgtagacaaaaatgcggtattcgccgttttcatctgtctgttaccatggtcgattccaagtatttctctatccataatgactgtctcctccttatgtttaatattctccagaatgttccaaaagttcgacttcttcaaccgcttctccgaaaccctcatcatcttcccaatctggttcatgttgctttaatataataacaagatttcccttgtcattattctcaaaacccacatagcaatcttctgattcttttcctaactgtaataactccatgatttggtcaatcttatacattttcatcgtttctacctcctctatatgtcataacgcagtttaacggcttccagaaaatattttgcatatgggcaatcaaagatttcttcaacagcataatctgaactgtcttcccctatatgatatccttctattgaatcgtcccgttttacttcctgcgaaaatccagtatagaggttaatcgccagccgtgttaccttcacagaagcagatgtctgccacccagcgaataaaaccaacggattcacctgaaaagttctttgatccacaatatttgaaaaagctgcccttgtcttgtcacagataccaagagtatatatcatagcaatttcttcactgtccctgcgtgaatttggaagttcccgcaccttttcataaaagaaacgctcatgtgcttcatcggcaaatactatgtccattacctccagcttgttaatatcaaacatattttcctccacttcttatttggcagttataattcctgcaggatagattcaatattctcgttaaatatcttttgcaagactaaaatgactttgtaggacggcttttgttgcccgtattcaattctctgatatgtgcggagactgatatccagcttgtccgccaattcccactgtgtcaaattcttctctatgcgtaattgtctaaccctagtaactgctcatcaccccctttgctcatgcatattgaggggagatgtcaccattcatcaccacttgattcataacggaattacttaatgtgaatgtcgcattatataaggcggttagcaacactgcacgcatattcctgatttttgttttcgtctctgacaggttatttaaaataaactgtattctaaacatatctaatttccaaaacaccgatttaacaatggctgttggtttttcttcctggttaatacgaatcgtatccttcgttgaagtcagtacgtcaactgcaattcccacaatttcatccagacgatcaatatcaaagggacgatcaatacataacgcatcgtatccaatcttttctctaaatgcctgtaacgttttttgataggactggactggattggtataatctgtcgttgaaatatctgtgttaatatctgtatttgtctgcctgttaccagatagtgctgtaccttctgaaaagtggcacctgctattttgcggcgtggcaggtatctcttttttgggtgataccctctctctttttggggagacagctccctcaccaatgactgccatctcactattattcacagtaaagcactgtccttcaacgatttcctctacaatgtcttcccccctgtctcccatagaagggataggggcatcataacagtgcggatacgttaattctttcaatttctcaacaatcaactcaatatacagtacattatttacaacaagtccattcaagtttattgtcctgaatactctttttattacgcctaatttctccaaaaagatgattgcattagtagcttcttttttactcaatccaaactgttccgcaatctgttgataacttctctggagtaaatcagctttaaattttttacgaattgcaatgatctgtccagtgctttcgtccctcaattcagtaggacgataccaatagacaatatctgataatataacgattgcagccaaatgcggttttcccgtctctttaacaatcgtcttataccatgcttgtggtgtaatgttgccggtaatactgatttcggcacttgcatctacgattcgatttcctgtcgtatactctcgcatcacgctcacctgcccttcttttcaagagaagtacagatggtgcgtaatctttcgtctgatttctttgctgtcacagccaacgaaatacttacgaccattggcaacactatcaaaaaaataatcacaataaatagtatctgcatacccttttcctcctaaaatgcataagaggactaaggtcagctaacaaagttgcttcacttagtcctctatattcatttatttttaacagcgctgttctcccgaaagagagtttttacttcggacgaagcaaaagaaaaggatatttggaataggactaagtataagcaggtcccaaaccacccggttgcgacccctagccttaaaatatcccactctttggaaaacgacactggatttttaatgaaaaagcagttcgattgtggtataataaattaagaccaaagtagccgcaaacccttgatttcattgggttccttgctaacttggtcttattataacacggtcacctgctccgttttctccgagcagaccgtagattccctgaccgatctccacatttacgtgatctactgccgtgactttttgatgaaattttaccgtaagattttctattctaatgctcatatgatcaacctcttttctttatgatggcagaaatcagtgcggccattaagacggtaagtcccaatgcgatcccttttccccaaagccattccatattatttatattttgagtgtcccggaatacaaatgaaaatacattaaatttccccagaacgctctccccggtcacagagtttaaagataaccataaaataatcgataaaccgattccgccccatatatttctcagaagatttgtaaccgtcatagcaaaagtactccaaaaagaaatagtaaccagcacctccggaacatacactgcaaagagcagcattgacggtatggtatttaaattatgaggggcctgccaaaagaacagtccatatccgatcaatgccaatccccataaaaagatccactggacaaccagtcttttcaaaattgtctgcttctttttttttactgagtacagacagaagacttcccaccgttttccgctgtgctccatccaataagtatcggcgcaaaacacaatcgccaaaaccgcaatatatgcatccatagtaatccctatctcagcaatgctgctgattcccctcaccagactcagaaaaacaataaaacaaatagaatatattattttgtaaaccggaagacaaattttcatctctttcatcaataggacctccatttcttccatgctgcagctgcgcacaaaataagcagaacagatgccagtacaaggaatacctgatttagtaatacccatggcgaaggtgaagtttcaaagaatttgcccggaaaccttaccatgaccgccaacggcttcccatagtatccatactgtccgtccggcccgattgatcccatattggagtagagcatatacagaagcagcagcggtgcagccggcagaggattcttgaaaacaactgcggtcagcgtatatacactgacgatcatcagcatattcggaacaatatataagagcgacgcccacaacagatcccatattcgtactggaaatccggctctccagccgcacactgcacataaagcaccaaatatgatatttaaaattgcaagtataatcatcagtgtcagaaaacctcctgagactttacctatgatatatctgcctgctgatataggttttgtatgcagcatttcatatgtgtcccttttcgtatctctgataaaaagaaatgccagtaagatagatgcaaagaatcccatacataagcctgcaaagtcagcaaacttctttgaaaaataataagtaaaaggtttttgtttgaattttgaactcatgtaggaatttatctcttccttcgttcccttatatgtgcgggcatcttgaaatatattgtctgcactataaaaatcatagttttttactaaataagctgacatttctgcatctgtcatatttttctgttccagcttatggatcacttcctgtgcctgcttttctgaatagccaaacgatttgacaagagcgtccttaatctttttgccggccagttcccactgctttttctttgtagacgggatatatccttctaaaatatcagcatccgccctattctcagcacggacttctttcaattgactctcagactgcacataatgcagtttcagatagctccccagattttgaaataacagaaaaatgacgatgagcagccctgcccagagaattggattcttcagatagttttttacctctctttttaaaattatcatcatacagtgcaccctccttcctcttatagatacactgtacgttacgaatcactacaaaaagacaataagaacaaagttgacaaggtctttctgaaaaataaaaaaccggattctcatccgatttttttatggtttctatgtttttaatttaaaatatgcgcaggcttctccgccctgatcctgattgaccagcagcagctttcccccatgtttttcacagtagactctgctgatataaagtcccagtccgaaatgcgtcagatcactttgagggttcccgtgataatatgcctttgtcaaaagctctgcatcttcttgaaatcctttcccatcatcctgtacgcaaaccctcatttcatctccggaaatatctacttccacataaacctgctccctggcatagcgaagcgcattgccgattaaattattcagcacctccaagaccatttcggaatcaaaatacaccgactgctgatcagacttcacgaccgtatggcactctttttgtgcctttttccccagaatcactgtattgtttttgactatttctataaaatcagctacgtctatttggttccagcatatattccgttcttccagcttcgacagcttctgcattgtattaataaatgccttcatccttttgatctgctgcataccggcttccagcattttcatgatcttatccctgctgacagactcctggggaagaaactccagcagcatttcctgatagccttccataaccgcaaggggcgatcggatatcatgggaaatggcagaacgcagcgccttttcttcttctaccattttccacatttttttattgttctcttcaagctgacaccgcatcttttcaaactgcctgcacaattgtcccatttcatcttcatttgaatatgcaacagaaaaatccagggtgccttcggaaatacgtgcagatgcctcttttaattccccgaggggaatttgaatcttatgtttataaaaaagcaggactgctatgattgttcccaggcaggaaattaccaatatactatatgtatcaaggaaatcacagagttctgaaataaccctgtccgttttggtcatagaattcagctttgatcttgtaatgttgatttcataatcgtctcctttattctccatcgcctcataataacggtccttgtctatatatcgaaaccagatcttctgctgagcgtcatttgctgtatgaatgatgacaaacgacaggccataactgagaatcagatttaatcccatatacagcacaatggtttttctgatcgataaattccttattttttccatcggtaccccattccccagactgtttcgatatactcggccattgtatgaacacttaatttccttcgtatccttctgacaagctctgtcatcccccggctgtccccttcaccgtcatatccgcagaccttttcataaatccgttctttgtcaaaaacctgccccgggtgcatggataaaaattctatgatcgcatattctgtttttgtaaactccactgcacagccatttagtttcacggttctttcagtataatctatcatcagtccgtcacaaaaacggtactctgacttatttttatgcctttcttctcttttaagatgtgcagtgattctggcttccagctccttaaggctgaaaggctttaaaacgtagtcatccccgccgaccatgaggccgttgatccggtcctgctcttccactttggctgtcaggaacataatcggacaggaaatcttatcccgaatctgcctgcagacttccagaccgtcaagccccggcatgttgacatccagcaggataatgtccggggcatcctttatccgctccattgcttccagtccgttgaccgctgtttctatgaaatagcccttcagttcaaaatagctgctgagcatctgtaataaatctttgtcatcatcgacgagtaaaatcttgtagttcattgttatcacctctggtttatcttacatgaagaatgtcaacaaaggaacaacaaactattttattttcaagatttttctttgatcacagagagagcctcctcatccgcgaatacggcagtatggggatgtaatttaaggatagatgccgggactcccggtgtgatatcaccgtaaacagcctcatacagagcctgggctttctgttttcccgacgcaagtaaaataatatgtctggcctgcatgatccctttgatccccatagaatatgcttccttcggtacttcttcttttgagcgaaaaaaccgggaattcgcttcgactgtgctttccgttaaccgcacacagtgggtatccggaataaagacatcccccggctcattaaaaccgatatgtccattggcacccagcccgagaagctgaagatcgatccttcctttttcttcaatgatctcttcatactcacagcatgctttatcagaatccatttctgtcccatccggcacaaacgtcctggacttgtcgatatttacacggtcaaataaatactggttcataaagaaacgatacccctgctcatgttctgcaccaagtcctttatattcatccagattaatggtggtcactttggaaaaatcaagctgtcccttctcataccattccaccagccggtcataaactccgatcggcgtagaccccgttgacagtccgaggactgccctggggttcattcttatttcggaagcaatgagctctgccgctttttcacaaatttctttatagtcttttccttcataaattgtcataacataaactcctatgatttaatctcttttaatccgaaccttctgccctgtctccagactttcatgaacagcctctgctaccaattctgcctgcagcccgtcattcccgtctgcgatgaaaggaatttctttttgcaggcaatagatgaagtcgttgatcggctcaatcccgaatccgctcggcctgccgcagttatttaaaataaaatatgaattcggagtacgctgtttctcatggttaaacatttccacaccgcggttttgtgaatcaatccggaacatggcgttttcacagaggatctgtgtcctgccgtcattattttttgcaaaccctttcggaagaatccaggaattttctactgtccagtagcatccgttttccatctttaatgtggcctggatcgaatcataggtgtcaattccttttgattttaagaccttttttgtccccaccgcagatacttcttccacttcacatcccatgtaccagcgaatctgatcatagcaatgagtgccgaggaaatgaaccgggctcgatttgtctgcccatccaaaccattccgtcgggacgtcgatgatgtcgtccatgttcatatatccgcggacaggcgctcctgtttccgctttctgcagttcatttctcacattgatcgcggccgggtcccatctcttatgataatccaccgcgacacgcaccttatacttctcggcctccgcaagaattttcttcgcgtcttctgaagtcgtagccaaaggcttttctaccaggattggtttcccatggcggatcgccgccagcgccggctccatgtgaaatgcgtcgggagttgcaatagacaccgcgtcaatgtcttccttatccagcatttcgttgacatcattgtaggtcttgacctcatactgtttggctattttatccgtgatttctttattcagatcacacactgccacaagatttgtgttcggattccatgtataggcgttcacatgattaattccgtatattccggctcccacaaccgctacattcataactttcatcttcataatctcctttaaatttttctcagcttacttattcataacactttatctaaaaaatacctattaacgcacacaatatagaaactgcgatgatgccgatgacaatctttcccgttccgatctttttatgtctgactaaatagtagatcagaaacagggctgccagaggaaagatgcccgggaaaattccgtccagtttttcctgaatgacaacactgctgatttttaacggagttgtcagtgtgaccatggatgcggtcatcgctcccatcataaacatcgcaagtacattggcgccggaaatcacgtcctgcatgagaccggagcccataatagttttgatggaacttctcccttttttataagtcagatttgtaaaaaatactaactcaacgatacaatacatcacaaacgcgagtaacactgaaagcgcaaagggattccccgctgccgccaatgtagccgctgctattttaaacagcgtgccgatgataccccagtcaaaactgtctcccagggccgccaccggtcccataagcccggtctttaaccctgtgattgcttctgccggcattgcttccggttttttagccctctgttcttccatcgcaatggtcgtcccgaggatcagcccgccagccgtgacgttgcagttatacagcagcaaatggcgtttcagcgcctccgccaggtcttcttttttcgtatacagcttttttaaaatcggcgcgatgctcccgcagaatgcaattccctgcatgttttcaaaattcagcggcatctccgccgacatataccagcggaacatcgctttatttaaatctttttttgtcagtgccggagctgtatccgccgtcgttacttccttactcatcgctgcttacctcctccataatctctctcttttggaacacataaataaatgcaatgcagattccaatgattccggctgtcagtgagttaattcctccaaccgagatcacaatgtaaccaaggaacacatacgggatcagtttttcttttccaatcatattcatgataagggcaaatcccaaagccggcaggataccgcctgccacttccaaaccgtgagtcacaaaagtcggaagagcattcatcagatttacaacaacgtcctgtcccaccatgttgataataaatactggaagaaacagaagcggaattgccaggagagcagggaaaagtgtcgcacatctccaaatgcctcctgcattcccttcctccgcataatcatttgccttctttacaaagtatgtatttaccactttccttaaattggtcacgaaagagccaagcagtccgaccggcacagccagtgcgatagccgtcgttgcactcattcccgaaccgattgcgatgggaatcacacaggttgccgccagacactcatccgtcggaagatttccgcccggcgcgataattcccgcaaatacaagggcgattcctccgccgatgatcaatccctgcattggctggcccatcaataaccctgccacaagtccgacggtgaccggactcgaaataaataaaaatccgaagtacgaaaagatcattcctctgcaccaccagtacatgatccccatcgtgaccgcaattataacagtactcatagtttaacctcctacattttctttttgactgtatcaaaactgattgcagaaatttcaggaatcggctgaaccgtaacttcaacaccctctgcattcagttcttctaatttttccagttcctctgccgaaatcgccacgccgcttgtaattaacttctttccgtcttcgttgggaactgcccctacgttgagagaagaaatttcaacccctttccggattgtccgacagcagctgtcgatatctttaaaaataagaaaaaccgtatcgttggttttatccaaaacactttttgctttattcacggttacaatatccacggcggtacccttgggcactgccattttgtaaatatcactcataaattcatcgctgcccagcacatcatccacgagcacgatccttctcaccggacttacctttaaccattttgcgacaacctgtccgtgaatcagacggtagtcaatcctcaccattttaatatccgccatctgtatacctccgctcttccattgatttgttaggacacatgattccatctttgcctgcttctgtacactccgagatcaaattgtccagagagctgtcctctctgcttgatacaaactgaatcagcatcggaagattcacacctgtcaaaacacctacgttttttctcatagaaatttttagcgctacatttgacggtgttcctccgaataagtctgtcataatcacgacaccggcgccttcatccagcctttccacgtattgctccagtttcttttctcccagttcgatactgtctcccgggtttaaagtccatgtctcgcaatttttcaatggccccgaaaacatctcggcgctctttaccagttcttcacacgtatttccatgagttgcaataattaatccgaccattttttcctcctttccaggtctatattaagatttcctgacacttggcatgtaattttcatattctgtatcatttcgcctctgcaaatatatatagcaaagcctgtgccaacttttatttttctgcaataaaaaaagcctgtatttttttaaaacagcataaatacaagcttttttcgccttttattatttaaacattttttatcagactataaatcatatgaatttccatatcgttaatcgacacattatactgggcttctaagacagaaaaactctcttttaagtttttcacaaagctttcccgacacttcaagctttgtgtcggattgctttctgataattgtcctttttccaaaatcagtcgttccaccattacacagatatgaatataaagcatctttttcaggtcaatcggataattttctccctccaaaatctccagccttgtcaatgctttttccacatcgtctaatatcttatccgggttgaggatcgtcagctgtccgatcaaatttctcatagtaaagctgcggacaatattttcaataaacttttgaaccttctccttatcaaaatatttgcctacggttgcataaatgacctcttctccccgtttgtctatcagttcattcagatgaatcgccgtataatcctctgcctccaatttactcgtggtaactacaaactgcacattatatttccggaaaacatcacactggctcccgtccctctgcaaatccggaaacggtgtctccactacctccagttcgattccttccagacactctttgaggagagtcttcattttcacggcagtccccagccccgtgatgcagcataaaacaatggccttcggtttctgtctgctgggcacatacgacttttttgtcacatggtgagacagaatattgtccatgatactctgaagatcttcatggcgcaggatcctctctcccgcctctaatgccatttccgtcgtaatattgttgacaattccaagatccccttcaatatcgtcttttaagtctctggatatactcagcagagaccccatatctacaaagatcaggagaccttttgatgtattggtattttttaaatatttttttatcctcgacacaatctcgcttttcggcgtatcgtatgccatatcaaacgcctcaaagatataagtttcaaataccctgtttaccgtactcgcaatactggacgccgttgcaggtccgtgggatacaataatcgcattggtatagtccccgtcctcctttgccatactgtaaaaatacagcatagcaaataatctcacaaaccagggacttgactcatagtccatagtctggtgaatcatctccgtaaaaatcaatcccattttatagtagcggtacataaccggctgcagtttcctgacgatgatctcatactggctgtcgtcgggtttatcgctctgattattcagggcatataagatttttacaaacaccatctccataaccccattgtactttaagccataattgtcctggagatacaccaaaatattgttgaccgcctggttataaagattttgtataaaggggtccatttcctgataaatgacatcgtctatcatatgattgatctcatcatagataattttgcgaaaccggacctttgatattttcttttccaggtattcatatactgccgtgacaatggtctctgccgggaaatacacatgaatctgctctgttgtaaagatatactgaaccgactctttttccgatgaaatctcaacgtcctgatttacataaggaacggaaccagtgcctgtcataaatttctgtgtatctgataaatgtctcagctttaacggtaccggcccctttttgccttccgcctcattataagcctttgtacacgacagcttaagaatattgcgaaggctcccgatgttccctttcccctgaaaggtcagcaaccggttgatcacattgctgctcaccaaaaagctgcattccatgacaaatgtctcctgatgaatcatataaatgatcagctgatatctttcctccagagtccgctcatgaaacggagggagcgttacctccaccggaatcctccttaagaaagtatccagcatggattcctttccctctgttgtggcaaaaatcagcctgacattgagttcaatattatgtccattatcaccaacccgtgacacaacccctttgtccatataatgaaataatttttcctgaccttcaggcgaaagacggtgcacctcatctaaaaataaatacccattatccgcttcctcaatcaaccccctcgtgtctctgtgcgccccggtgaaagcaccttttttatatccaaacaagacagaagacagcagttccttgttgtttgcatagtccgcacaatttaagacgacaaacggggcatcctccggtatcgtgtggatatactttgcatatttataaatatactcagccagcagacttttccccgcaccgcttggaccaaacagtaaaataggcatatcccgtttgagatagatcgcagacaacttgcacttttccaccgtctctttaagacttttgtccgcaccaataaaggatgcaaacggatcgtcggaaaatgtcgaatcgttttcaatataagaaaacatcaccggacgtgttttctccttccggacgattccgtctctggcaagctcatttaggatagcgcttgcagtgtttctctgaatacccagacaatcggcaatttcttctgcggtttgtttgtttctgctctcctgaagaagttttatgatgttgtttttgttccctggttttcccattgatctctcccatgccattggacttgtggttggacttccttataaaagaaatatagcatggtggtggggttttgtcacttgggaatatgttttcattatgtttgtcattaactaaatatattatatagttgctctgtcttgtgtagattttaataatcctctctcatcagctaaacaaaattcctcatttatctttattaccagcaaaactaacaatcttagaagagtaaaatagtcctgttcatgacttttttcatctattggttgtgttccatgtacataacgattacgcagatccaaaccattactaaattctgctctattcaaaatataattaaaataatcttgttcaggctttgacaacaacgatgttccatattctaatacattcttttttaccaactcttcgattaaagattttatactttttatatagcttgtgcataacacttcatgaccgagtagttcctttatagctcaaaccttttttatattatttcttaggaaccgttcctcaagaattattatatatatttagtaaaaaacaaaaattttttattcacttgtatatctccatatttttttatttcttttaataaattctttctatcggctaaatttaaaaaaatatatatgcattaacccaaatttaaaaaattcatcatttgctttttctactatcaagtaacttttttgttcaattcacgaccaatcttataactataggaatcaaatttttctgttacttccgctatctcttccgtttttacgaaaaagtctgtagttaggtctcttccctcctaaaatatcacgattagcatatcattatagtactaattacttaactcaaagtttaatcaatttaggtcaaaaaattctttactttcattaattatatgatataatttatcaaaacactctgacaaaatcatgtcattttgacgaagattgaaaaaattagaaatcatataaagatattcaaaatagcaagtagatgttagaaaatcgcaatatgaatctaataaaaactagctttaggtacacctcatttaaccaccaattatcatggaatttctattatttttaatattattatacatataaatcttttcaatcagtagaaatttctaaaagttaatttatgaatcaaatataagaatgccctgaattttcaaaattaattaccaatttactttctagaataaatttttcaaaaggatgtgatttcttatgaatttaagttctataatgaatattgcattatcaggaatcgctggagcggttttagctctaataggaaataatcttttatttaataaaagatcaaagaattatgatttaaaacttgaaaaagaacttgcagtatacaagtataaaactgaagcaattttagaagcaatagaattcttagaaaattatattgcctcatcacaaattgaaaaaacaccattcaaagaaatgactgtaaacgaattaactatacaagccaggtcatgtatggataaattagttgtatattgtgataatgcagaattagttgaaacttttgatagtattattttaaaaggggaaactgttaaatctaaagaatatatagaacgttttaaaaatttcaggactttatgtcgtaaggaacttggacttaaaaatgttaaatttcaaaaagatgaattctattggtgtatatctacaagtaatattaagtaaaggggattgtcaagtaaaatgtataacttttgatttttagaataccggtagccgatttcaccagtatttttgttgtatctgagtgggtctcctcttcccttttatccctctttctttttgggtgtcaaaacaaagccttctcttttgcctattgtggatctcgtgttttatatcccttcatattttctcacccgcagctggatcttgggatccatatccatttgattcctcaccatcgcccagttccttacatgccctcttcccattttctatataattccttgatccgcaggtacagcactttccgcagcacatcttcattcgggaacgctccctgcttcgtcaccttttgaaaactcgaatggatactttctaccgtatttgttgtacacatgatctttcttaccgtactcccatagttgtatagttgttctacatgggcaaaatttctctcccatgcatctaacgctcccggataggcactccatgtctggttttagtttctctaattctgcccttgcctctttcacactgggcgcaccatagacctttctttaactgacccgtaaatcacttatagtttttgcttggtacgtacttccccgaattccggatcagatggaccatacacctctgtaccacctcgtttttgaagatcgcttttgccccgctctccaggccactgactccatccgtgcataaaaactccccgtgctttgatctcatcaaagatctgcatccagctgtgcttgctctcagtctcattcagccataatccgagaatacctttctttccgtcgatgtcatatccaagtattgtatagaccgcatatttctttatctcatattcttttcgaaaggtataacatacagtctgcaaagacaaacggttaacattctttcaaaggatggttctgccattcctgctgttgttccagtacacagtccgtaatataagaaatcgtctcatgggagatctcgaatctctagacgtcctggattcattgtggaaatgtcgcgctggctcattccttttgattacatggaaaggactttgtcttcaataccgaagacgttcgcaggttcgtagtccgcttgggtatgaccttagggtcgaaactggcatcacggtctcttgaggcttcgatcgggatatctccataagaggtcttcatagtttctttcgaataaccgttccagcagttttatccatccttttcactgcgttcattgctctcgttttggtacacttcgttaatagtgttttcacattttaatgtatctagattctaattatgtcataatctgcgccacaattacttcagtactttctataactattattcatcctaggtatccaactttatctattcatccaatccttaattcccgtttccgttcttttgcaggaaaatacgtcatatacttggaaataaaaatctgagtattatactccggtaatgtatacttaactggaacttattaatttgttaatctatttcatcaaaaaaatcattataatattcataaaaaacaacacataaatctttatataaactctccaaattatcaacagttttgtttaatctctttctattttcaatttcttgttttacttcctttaattttttatgtaccctttccaagttataaattagttggtgtctttgtaaatataatttcaattcataatacatatactctccaaccggtgttaaatagaatatagatccgtcagggtttcttttcagatgattattatactcatcactgcacggatctacaaatccattatttccaacgacatttatactgctactttcacttggccatttgttagatttggatatattgcaaaaaggacaagaataaagcaaattatcataagtaaatttgagctctggaaatttttcttttggagcaaaatgttctacatgatacattttgcttcctcctgcatatttatctgcatcgtcgcaataagcacattttttatcaaaatctataatcaatcttttcttgttagacttgttagtcgtccatcgaattccagaatatgatctagatggtatattttgttttattttcatttttattcctcttttagcaacatatcaattttactaataagttcatcgattttattagcctcaaatatctttttaatattattaggtattgacgaatatccatctattgttctttcaagttttccgtctatgtccaatattttattatcaatttcggcactctttcccttttgtggcaaaagcttttttatttcccttttccactgctcaatttgctttctatactttgatacttgttctattaatttgtaatgtaactcgattcgttctttaggttctgacaaatatctttcaaaatcaaatatttgatacgtatcaaatatttcctgttcatataattcatcctcatatgatgttaatataaataatggaaatccataaaatctttggtctatatattttgcgagttgtacacctgtataagaaacagttgcacgtgatgatagattataatcaattagcaaggcatctactctttgttccaaaaccactgttgctatgtcttccatttctgtggttaaatctatctccactacttcaaattctatattagaatatttttctaccttttgctgtgaagcaccttgtataccacacaaaagatatgtcattatttgcgtaactttactgctatcatcatctactataccaatttttattttttccataattttctcctacattggaatctttaattcaatgccaaatccgttcttcgtttctgttagtttataatctccattatattctcgtacagttgaggcaataatatacattcctaacccagttccgattacatttccatactgatcatatttgctagttgtccccattttaaatatctcatacggatccttgaaattcccatccaaacctattccattatccatataatttataataaaatattccttagtctctaacttgatttttatggttctattatccgtactagctttcgagaacgcttcaatagaattaataattaaattatagattatactttcaaaatcggattcaaatatccttctttctgcatgattgtcatccttcattatgtttacattaacttttttctgtaaaagaattggctgcaacacatcaactatttttttaactgtatcatacaaatcttttttcgttctttttcttttatcttttttactctgatttgttactacagtaatccatgatttgagaaacatatcattattttttaaatctttcaaatttctttcaatcaatatatgattattgttttctattgcaattcgcattgtatctactctatttaccaataaagcatttatactttttaaatcatgaacaatagatgttgtaataagaccatttgttgcaagtgccctaagtaatttcaactcagaaataagttcttctcgttcctcttcgaaatattgaatagtcttagcgagactttcaattttctcattctgagattttcgacttttatcctttttccctgtcaatacattccttgcaattttgctaccctcttgctttgttttttctttatgattaactctatcatcatatttcttaaaactttttacaatgtatgatctatccttttctagtacagcaattatccttactattgcttcttttagcattataaaactttcattttctataattccttctcggctagacttgtcaagtatagatgaatttgaaatacgggaaataaatacagtgccttgaccttgcgcattacgtacagtccatgcttcggtttcacttgaaatagcgactgggtttgcattacttcgtgcttctaagcctaaccaatcatatgaatcggaatcactttctccataaggtctaacccagaaatggtcacgatatatcttaataccaccatgttcttctaaccaataccctctattttttcctatttctttataaaaaaatatttctttagctcgtttctgcattgtcaatttcataaagacataatcaaaattgaatttccctatttttttaaccttttcaatatattcattatctgatgtattaaaaagctcacttatcgaatatgtaaagattaatttttcagcttgaaaatcttcttttctatatggatatcgtgacattcgttcttctctaaatacagaatctggtattttattaacatcaaactcattccgaaacaattcaatattaaaaaaatttccatcaaacttggcattaattttataatcatattcatccgaaaggctattttcaactaattcatattgtgatgtattatctttctgtacacatataaaaaattcatcctgttctcttggcgggaccaagaactccatggattttctcattttttcaatctgaggcagtaaccattcatctcgtaattcgcttattttaataactgttcctgtagaaaaatccatttttattgcagattcaacttctagtttttgaatttgttttaacacagtttcaggtatctttgtttgtaaatcagaatccacatattcaaattctgcttcaacatcctctagtgcttttccatcctcctcaaaactattccagtttgttttccatctaataacactactttcatcactatttcttgtaaatagttcgcatacgccccctaatctatctaatgcaaatcgtcctattcccttttcacctgatttaattctctttttagtggaaatatattctttctttttgttatctgttccaatcatcatccagttatcttcaattacttttttagtcattccaattccattatcaattaaatatatactgtcgttttgtatatcaaataataaataacatactgaggcatctgcatcatatgagtttttaattaactctataagagcactttctactttagacacactttctcttcctaataagattgtagctctagatgaaattttatattttagcttttccatgcatttctcctcctggtatgttattaaaacctatattcttctatgtccttagatgtaattctaagggagcttccgctaatatgtattccaaccttctttacatattgcataaactcatcactttccaaaattgtttttgcatcatctaatttatataactgatttcttttccttgtaataatatacatccctgcatatggaatgcacttcttatccaatggatacactgaaactgtatctgttataaccgtagaaaccaataattttctatgatttaaagtagctaatgcttgagatcttccatattcaaaccattttgcatttttgtcactttctcttttatctaattgctccctaaatccatcaaggtattgaaatgcacctggaaagttacttataaaatcattctgactatactttactaactttcccttgtcataactatacggaaaaataattttttctatttttttatatcttttagacctcggagtagcagtctctcgcactactgccttttcaatgtttactccatttacttgataataaccatctaattctatatagttttctttttttagaacatatgcttcgttcaataaggtggcaaccacatgtgatacttgaaaataatctccaaaacgtcttgtacctggaattgcatcatttgaaaaaaaccatttcttatctaaattaattttatcaataattatttcaattcctgctgcaatatctttataaagtaaatttgcatttttattattctttgaaagcaccataattgctgattttactagcgcattattaaacatcttcgcctgcgtaaaatcatggatttctttaatatatggctttatatattcccttaaattttctccaaatactgttttgaaaatactactaggaattaaatatgccatttccccatcttctacaagacaatcaatacttttttcaataaatgcataacaataatcaaattttccttttctgcatgacttaaacttgtttttcagaaatgtttgttgatctttcttcatttccttataggtaatatatggtggatttccaactacaaactggaacttaccgacatcatcaatttgaaaatagtcattattataaaaattccattttatagactgtaagtcattgagctttaaaacattattcaaattacagatgcatttctcatattgttccttatctatctcgattgcacaaatatcatttgctagaccagctctaatctgctcttttgataattcttgtctattgcaatcatctatatacctctgtaccacagctaccagtatatttccatcaccacaggaattttctaatatcctttttccatatagattctctgtataaccaacactatccagcaactcttctacataatctgctggcgtaaatacctggcattttttgttcatagtttacctctttatctacatattaaaaatcaagccttgatttttaatataatatgtttttgtaaataatactatttgtacgtccctcttgtatcacataccctgtttcaactaaaaattttatatatcttcttgttgtggcagcagtcttttcacatttcaattctgcttcttttcgagtaatgcttccttgatcctgtagctcatctattatttttctaactttgtcatatccttttatttttagaacttcgctcactcttttgattgaagtctacttttgtttcaagtccatctctaatcttaattgttgtttcaagataattccgttcatcatcagtatcaaactcaggcattggagaaccattctttttaagttcattaaaaatggtaggaattcctgttgactatttttccaacaaatgcagttctttaaagaattctcctattatccagttacgatactttctgacacgttctttatcttgcacaagtttatccatatcaatccatttagctggactaggatagtttgaaattacaatttcatctgtatagattcttatttctacagatgaatcatctctatatgatttatggaaaaccgtatttacaacagcttctcctaatgcattatatggatagttataaaatcgtgccgattctgcctgattttcatttttctaaactttcacttctatgatgttattttgtatataaccaagtgaatcttttacttttttccagattggacctgtaaatgtcttttaaacaaatctctagatgcctccgcttcctctgtattaaacttcaccagatttatcaatgcgccaggaattagcttatccggtctatccatgaatataagaacatcaatattacgaattgctaaatctgtgtccgtttcatttgcgagttctcatgaaattaataaatctacaagggttctcttgttcaactctcctacttatgaactattactatctctgaggaactcttctacatgtccacgtctaatatcagctaaggtagcaattctattaattcgatcagcatagggaattgcattaaacttttcacatattccataaagtctttttccaattatatcatatctgtacatataaaataataacctatatttattatcttcctcaaaaaatttaacaaaattctatttcctaattacatactatccttatacttctccctattcaatctcatcgcaatccccccccccgaaagcagatgcctataatacaatgtaatcctcttacttttatgaccaacccgttctccaattgcaactacaaaatatccaagatgcaaacgcagtgaaacatgtgaatacctaagattatataccccaatatctttcacttcatccttttctatacatcttttcatttctcttcgcagtgatcctcgtatatgcacatattcttccctctcttacctgtgttggctctagataaatatgcaattcttgtatcaaaaatttgacattgtcacaacacgaatacttctgtctgttttgctctactaaaaatatctgaccttttatttcaatgataagtctttgtaactgaaatctgaccattttctatatcaatagcttccaatgtaagggccagtcccccttctctaaatccacactaatacaatacttcaaatgcatagtaaaacatggaatctttctcaaccatatcaataaatttaaaatacttttactttgtcaaaaaattaatccgcaatgacctttctgcatctattgtttctgcatcttttaccggatttcttggtaaatcataatattttactgcatgattaaagacagggctgagctgggtctgcactgtctttaaatattttttcgtatattcttctccatcttttgtcttcatctgaatcagttgattttgccattgcataatatcccgcagctttatttcattcattggtttatcttcgaaataccacaagaattttgtctccgctatatgtactttcgtgtgccaggtactttctgtgactcttggtttttagtctgcttcatatgtttttcaaaacgcttcaaatgttttatttagttcacgcttttgatctgtttgaactctgcctccccttttagtgcgtccttctttgtctaaatccctcttttggttttacgacatttattattttcagcatcccggtaatataatagttcttttcattttcctgtatttatttcatccttataagctgacatctaatttctccctttttttcgatactttatcgtatcaatacaccagatacaagccatggagtttatttaaatcgttttgaacaccaaaatcataaaaaaatgaacagcccggaattcggtccaaattatggaattcccgggctgttttaatacgaaaaggtactaaaaatactattcaaactcaatcgtagccggcggtttccccgtacagtcatacatcacccgattgacatgttccacttcattcacgatcctggttgtcactttcccaagcacttcccaaggaatctgtgccgcatctgcagtcataaagtctgatgtattcacggctctcagtgcaatggcataatcataggttcttccatcccccataactcccacggaccgcatgtttgtcaatgctgcaaagtactgaccaagtcctttatccacacctgcttttgcaatttcttctctgtaaattgcatcggcatcctgcacgatcttaaccttttccgctgttacttctccgatgatacgaattccaagtcccggtcccgggaatggctgtctcatgacaaggtattccggaattccaagttctcttccggcctgtcttacttcatctttgaacaggtcacggagaggctcgatgatctccttgaaatctacataatcaggaagtcctcccacattgtgatgggatttaatggtggcagatttaccgacaccactctcaaccacatccgggtaaatggttccctgtaccaggaagtccacagatccgattttctttgcttcttcctcaaaaacacggatgaattcttccccgatgatcttacgtttctgttccggttcttctactcccgctaatttttcataaaatctatcctgaacgttcactcggataaagttcaagtcatacggtccttccggtccgaagactgcttctacttcatcaccttcatttttgcggagcagtccatggtctacaaacacacatgtcagctgctttccgactgctttcgccagcataacggctgccacagaggagtccacgcctccggacaatgcacagagcacttttccgtctccaactttttcacggatagatttgatcatgtcatccacaaaagaatccatgttccagtcgcccttgcagccgcatactttgtataagaaattgtagatcatttctttgccctgttctgtatgcataacttctggatggaactgggttgcgtaaagcttcttgtccgcattttccatagcagccaccgggcaaacaggggttgtcgcggttatcttaaaaccttccggtgcctgggcgatatagtcggtatggctcatccagcagactgttttatcgcccacaccgtcaaagagcttggatgaattgtccagatccacttctgtgtgcccgtactcgctgacaggggcggtctccaccttgccgccgaggacatgggccatcagctgggaaccatagcagatacccaagatcgggattcccagttcaaatatttctttttcgtatgtggcggaatcttctccgtaaacgctgtttggccctccggtgaaaatgattccttttggattgtattcttttatttcttcaagtgaggcagtataaggtttgatttcgcagtaaacgctgcattctctgactctccttgcgattaactgattgtactgtcccccgaaatcaaggacaagaaatttctcatggttcacgggcgttcctcctatattcctatatatctttataaaataacctatattcttatatattataaggtaggcatggtgtttttacaactcaattcttccctgatctcattgattttgacagcttttggtgctagaatgataaaaaagtcgaatgaaatggagaattttatgaaattattagaggagcgcattttaaaggacggcgtattgaaggatgggggaatcctcaaagttgacagtttcttaaaccaccagatggacatcgggctgcttcaggaaatagggaaagaattcagaagactgtttccggaaaacatcaccagaatcttgaccattgaagcctcagggattgggatcgccacgatcgcagcacagtattttgacaatatcccggttgtatttgcaaagaaatccatgtccaagaatctggacggagacctgctgacctctaaggtaatttcttatacaaaaggactggaatttgatatctttgtagaaaagaagttcctgtccccggatgacaatatcctgattattgacgacttcctcgccaatggacaggcattaaacggattgatcgatcttgtcaacggctccggtgctaatctggttggctgcggtatcgtgatcgagaaaggtttccaggacggcggtcagattatccgtgagaaaggtgtacatttagagtctcttgcaatcgtggaagacccgaaagacggaaaattgtgttttagagaacaataaagatacatataagataagagttgatgatttttatacatcagctctttttaatactcaccctaaaataatcagcctgtttttatattccgcttcctccaaactcttgatataccgcaccggcgtcatattcgtatatttccgaaagtctttcatcatatgggactggtcataatatccggcattcatggcaatggccagcaggtccttttcgtcctcttcccatttcaggctgtttaaaacggtctgaaaccgggcgatcttacaatacgttttcggtgaaattcccatattctctttaaacaccttatttacataacggacagaataccctgtcaattcacccagttcttcaatctttacatttccggcccgcctggtgatctcatcaatcaggtaatttccaagatttctgtcttctaagtgctccagcttttcctgattacagttcacataaaaatttaaaaaagcctgtatctgtgcccggaagtcacggctttgaatgatcttgtcatatacttgttctgccttcataaattccatcagcgctgcttccccttcgaccagttcattgggattcaccgtatcaggcagtatgacctttcccggcataaaccggatgccgaaaaagtaatctcccggctttccgatcatcggggaagccttcagcctggtgccgatgatgctggcatatgggtaatctttgctgcaataaaacagaaagtccacacatccgtccggtacaatggacaggatgtcgtggacgtcctcttcgacttcaaatgcataaaaatgtgaaattccgtaagccatcatcacggccttatagtagtgggatgttgtcatgaccaatgacggctgcttgggtacaataagttttttcaggtgttttggctccatatctcttccctgcccctctgcttgattctactataatgcttcactgctgtgttgtacagaattcctgtgtattttattttgtaatcagattttggcttgaaaacgatcgtatctaaacgccgtcaaatccagtgccgtactgccgtccaccaccatctgagagagctgttcccctacagccggggcaattccgaaaccatgtccggaaaatccgcaggccaggatcagtccgggtacttcctcaactttgctgatgacaggaactttgtcggcacacaggtccatccatccggcccaggtgcggacaattttagcatcagacagagatgggaagtatttcatgatgccccggcagatgcaggatgctgtgatgcttgagttaaccggagtaccattatccttattgaagccttcaaagtttgaggaaccgccgaagacaaaggaaccgtgtttcgtctgatggccgtaaaaatccgcttccgccgttccaagcatttgtccgaacatttccggttctgcctctgtcaccagacattccagcagtgcaggctgcatagggatatccacgcccactgtacccgcgatctccctgctttcaagccctgctgccaatataatattctctccttcatacacgttttctttcgtaatgacctgccttgctttccctctgatcttccggatttcagtcacttcttccccggtaatgaacctggctcccaattccctggctttcttataaaatgcaagtgtggtgagcattggatttgcatggccatcggtaggacaccagctggctcctatgacttcatcagataagtacggacagatttcccgtacttcctcacctgagatcatccgcacatccaatccgcaggaccgggtattttcagccagtccgcttaaaattttcatgtgttcttctgtcttgccaagccgcaggtttccatcctgacagtattccacatctgttcccagctcttctgagagagacggccagagattttttattccatacatggcaaggggaagttcccgtttgtcccggccggactgacggacaccgcctccgtttctgctggaacccccatttcccaggtgatcactcttttccagtacgataacggagcagcctttctttgccagataataggcagtggcgtttccgattacaccgccccctatcacgatcacatctgcacaacgatttcccatattaccgtacctcctttccaaacactctcatctcggtaggacgcatcggcgccctggatacagccggttccagttctgccggagaaactcccagttcccgtgcagcgattcccttgaccagtttagaacaggtctgcccctgacagagtcccatgccggttcttaagtatctccggatctctgtgagggtaaacatcccgtcgtggacggctctccggatttctccttttgtgatttcctcacaccggcagatgatcatatcatcatcgtccgccggaatatatgcttctaatttcttagatctgtcatttatcgtattcacagttctttcctccatcttttatactcaggctttaagaggcgcggaaaaaccttgccttcatggccatgtcagcaggcaccctgatggtcagaagattggtgtggtcaaatcctttggatgtttttatctctaccacttctgccctgcatacttcgtttccgccccggtcaagcgcttttccctctgctcctttttctggcagcggaaggaattcatacggaagggtcacgcttgcataatctttctcaaattgctcgttcacgaggaaaattgcctgccctgaacaagcggctacacacatgccgcacccgatacactgagcgtccggatctactgccggcagggaagtgatattttctccgatcttgatgcatttcttaggacacgcgtcctgacatggattacacggaatattctgggtacactccatcaccggatggattcctacggtctttgtaactcccgggtactgttttacttcttcctcggctaaataaccattttccagcaggttcatggaaatatcacagccctcttctgtcttctttagaagctttcctttattttcgggaccgaacattccctgtctcagactttccagggctttttccagtgcagcgagcttctcattccgctctttcttatccataaatccaagggcacaggcagcagcaattcccgccatccggccttcgatcatcgcggaactggcctcctcaatgcctgacacatctccggcaacaaaaatgcctttgacggaagtctccccgtattcattacaaatcggtacctgtccgcctttctttgggttatcttccatctcacatccggccatttttaaaagctgggacatcggagacagtccgacggcaagacagatggtatctacgtcgaaatgcttctcagatccgggcactgtctgccagttttgatccacctttgcgatggtcactccggtgacccggtcttcgccttctgctttcacaatcgtgtgagataaataaaacggtacgccgcatcttgccactttggccgcatggaccccatagcctccgatccttggagctgcatccactaaagccacaacctcacatccggcctgcatcagctgataactgaccaccagtcctacatttccgcttccaagcatcagaatctttttacctggctggataccatgcagattcatcatcgtctgggcagctcctgccccgatcactcccggcagtgtccacccgtcaaaggtaaccatattttctgaagcgccagtcgccacgataatagcatcccctttgtaatgatggatttcatctccgatccgcacagtaatctctctgtccagataaagccctatgacagtggcatttaaaacgacctgcactcccgcatcttctgcctcttttaacagatcttctccgattttaaatccgcgtatctttgccttgtgttctttggaaccaaaaaatttatgtatctgcttaaacagctgtccgcccggtttcgcattttcatcaaaaacaatgacattcatccctttctttgccgcctctatggccgcagacaggccggacggacctgcccctactacgatcaaatcataccgtttcatatcgttatcatcccttcatcttagttttttctgcactgactccatactgagtctgaaccctcatcccttctttcagaggcgtcacacaagtcctcacgttaggcttaccgtccaccaccatgacacagtcggtacagcggccgatggcacagaaaatacccctgggctttccgtattttttcgtatgccggtgcaccatcaccccggcagccttcaaagccgccgcaatcggctcaccctcaaaacccgtcacaggctttccgtcataaaagaaagaaacctccttccctttctccatcctgcccaaaatcggatgctctgcaattctcatagctaaaaccctcctgttatatcttttcttaacctgtccgccgcgacaaatgctttcttttccacaactattattcagtattcttcagccaaaagatgccgccctgcgatagttttttatcactattggaggagcgcatttcaaaagcgcgacggaaatagtgataaaaactacgccattctcggggaatcccacaagttcagtttcgtcccaattccctgatccaatgcttttctgtacaattctgttccccatgccacatcttccactggcattcctccgatagagaacagaataatctcgtcatcatcttttcgtcccggaacctttccgttgatgatatctccgatgtcttcgattttcttcctcggcatgattccgtcgtggtacatatccacaaactttgttccgataatcggtacggtctcaaaagaaggatgaggatattcttcggtccatgcttcatataaaccaaagttgtctaccactgtctttgctttgttcagcagaaagtcatcttcaaagttagcgcacgcaggaaggctgaaaaatgcacccggcttaatccattcttctttgaccatcgggtaattttctgatccttccggacaggatgtagccatgctgatcacatcagagccccggaccagttcttccagtgtatctgccacctcaatcgtctgaaactgaggaaattttcccttcacatattcaataaaactttcaatagagcccctgcttcttcccttaatcttaatggtatcaagacacggacaggtacagacaaacgcttccagagccgttttgttcatgacaccgggcccataaatcccaagcactttggaatcccttctcgccaaatgcttggcaccgacccccggcactgcccctgttcggtaagcactcagcaggttcgcagacattaaggatctcggcgcaccggtctctttatcattgagcatcagcattaagatggatctcggaagccctttgtctttattctccacgttggaaccataccatttcatccccgccatgtcatattctccgcccaggtaagcaggcatcgccataaacctgcggtcaggaccgttcaccggcatgttcggaaagggtgatatatccggaaaagaaaccatacatccatgggaattcccgttagaacctcccatagcataatcccctctgctcaacagccggaacatctcttccatactctccacgcagcccttcatatccgtaactccgagcttcaccatttcctcttcatttaaatataaaaaatcaacctttgaattgctcataatcaaaacctcctgttttagaaaaaaaacttttaaatgctcattttagtctttcactgccagacccattttctgcacgattggagtgaggcattctaagagccgaacggaaatcgtgcggaaaatgtcacgctaatgtattcactgtctgcatttccggacattcgaccgttcccattttctttattccctttacccagatcactgagaatgcgatcaatgccagcagcaaagttgcgaatattttataaatcaggattctggcatcaccctcggcgatgttaaagatcatataaatgtcaccgataatgcagatcacctgagggatgccgagaagaaccagattcttatttctgccctcggcatccggatatcttcttctcagcacaaggactgtgatgttgaccataatgtaagaagtcagccagaaacaggatgccgcaaggatgatatttgtaagccctgaggactgggtaaagccagtgataatcaatgccgtgattcctccgctcagcaggccgattcctgctgccggaaccccatacttgtttttctgctgaaaagccttcggaaacaaatcattttcggccataccgcttaaaatattcgggatgcctccgagaacggtattgactgtacttattcctgccagcagtgtcacgatgcccatccagtagacaccggcctggcccatgcaccgttgtgcaaacagcatatggggcattggattcgatgccagttcctgcagtgtgacatactgtgtcattcccacaccgagcagtgcctgcaccccgaacaagacgacactgccaataatcatagccaaaagtacgtctcttttagggttctttagatcctttgataccgggattacgaattcaataccgataaacaaccagaaagccagcgccgataaagaaacgattcctccgatcccggtaacctgcggcttcgtctgctgtgcagccgtcactatctcgccggtacccagatggaaaaaacttatgatacccatgagcagaaaagatgccagcagaaggaatacgacaatgttctggattcgggcaaaaaaatcaactcctttatagtttacataggacagaacccccaatacgatcacactgatcaccggtgccggaatctggggaagaaagatctgattcagcaccgttccgcacatggcgatttctacggaaccggataaaatatcaacaatcacataagcggataacgtagataccatagatgccaccggtcctaaacccaccaaagtgtactgtcccaggcccccttctgctttcggcatcatggaatgcagctctgaaaaacttaaagccaaaaacccgttcagtatcagtacgacaaacagtgcgataataaaatttttgcctgcaagacccatgccctgcccgagggaaagcagacagctggtggctacgatcaatcccacacagacggataccgcacttccgagtcccaatttttttgttctctccatacatatcactccttttcataaaagaaaggcgtccgccggatatatctccggtgaacgcctttgttcccatctctcttatttactttgtttcctgctgatgggttacagcttactctctttctcttcatatgaattgtaaaaatcggaactctttaattcttttcttcaaaacggaccagtccgatataatatctggccgagtcatccagcaagactttcacagggatctcttcccgttccccgcagttggaccagatcaaaatctcccgttcctcatcatatcctgtgatggtcacccagtgccagttatcttccctgaattcctttctggaatgcctccagatcagcagcgccacagggtgtccgtgatacagcccttccctgataaattccaggcatccctgcttatctctgggcagaaacatacttttagccttcagctctttccctctgccggatgcaaagcttaaaaagtccttcttaaattttccgatcagcggatagcccatgaaaccgggcgtcatatactgatacatgccctccatgagttctagatatgattcatagggtatggactctgagttttctacttcttgcgaaaataagccttcacagacggcgatattcgtgccggtgacgcttccgcatcccgcacgccgctggaacgtgcccgggaaccattcctggttgccgccgtaagccaaatattttccgtctctatatattttaggacactttaattccatttcatatcactccttttcccattataatatctttttttgtcaagatatacaacccttgcagcatagactatgtaaaaagccccaggtgtgtgttatgaaacaattatcaaagaagcagcttttaaaactctgcatcatttttcccattttagtcagtctgctctccagactcctgacaccccggatggatgaggtcttccgtcagctgaataagcctccattcgttcctgccccgtggatcttttccgtcgtatggctgatcctcgatattttactcggtctgagcctttacaccctgctgacctcggacgtcacagaacaggagaaaaaacagggaatcaaactttttctcgccgtgtccttctttctgttcttctggcccatcattttctttgaatacgggctggtttttttctcttttgtctggatcctggctctgaacctgctcaatgtactgatgttctatgtattccgaaagtacagcaaaaaatctgctttacttctgatcccgtacattatctggtgcctgtttgcggcgctgttaaaccttggattcctgatcgtcaactaaaactttgtctcccgccggataaatacatacttggattccgaagacagggaaggttcaaactcatatccgtcccagtcaaactctttgatatcctccggccggtctatcctgttctttacaatatggcggatcatctgacctctggccatcttggcccatgccacgatggtccggagctttccgtttctcatggtgagaaactccacatccacaaaacggtccggcccatccagatattttctcacggttttggcatactcttcagaagccagattcaggatcagatcctgttccttataaagttccttataaatcgcatctccccaaaattgatacagaccctgtcctgctgtttttactttgcagcccatctccagacggtacggatgaatcgcatccaaaggtttcagcaccccatacagtccacttaagattctcacatgcctctgggcatatttcatatcccatccggtaaaatctcctgcgcccacgttctggaatacaaggccgtcataagtcatgagagcagcactgccgtccccgttctcaaaattttgtatatctaaaaaagcctgaagggcgatcttttcatttaccttcatcaaagattcgatctcccacggcttcagttttttcaattcttcataaatctgtcctgtcttttctgaaaacacaggatgtgtcagccttcgctgtttttctttcctgactttcatgttttttgcaggtgaaataatcgctatcatggtacttccttgtgttataatgggtttcatgaaaggcggtgcatcatgaaacaatttctgcttacggtttctttatctatattcctgatatcattttcggtcatatttacactgaatttccggcctctttactacgccgatataaaacttcttcatatcagccgggaatccggactctctgaacaacagatcagagaaaactatgaccggctcattgactataattcagtattttataaaaaagacctgaagtttccatctcttcccatgtctgaggaaggaaagattcactttcaggatgtgaagcgtattttctccggtcttcaatacgcctgtatcatctcatttatcataatccctgcaggccttttatggaagcgggaaaaaaaggatttccgtttcttaaaaagggcatccgtctctgccgccgtgcttccgctccttctgggagttctcgtctgggcggccggatgggacaagtccttcgtgacatttcacgagctggccttctccaatgattactggatcttcgatgaggctttcgaccctgtcatcaccatcctgccggatgccttctttcttcactgcgcccttttgatggccgcagtccttattctgttatgtgccgtctgcttcctcacaggaagacatctgtgccgcagacaggaatcttaatagtatcttcccagtgcgtccgccgcaatgatcgccgcatatacgtcctccggtgtcacttcaaacggcatgttgccgagagtgtcgtccggagagcatgcgaggcgtgctacttccatgatctgttcttcttttacttccttgattcccaaatctgcaagggtagtcgggagttctgcttcctgacagaatccgaggacttcctgaatctcatcctgatccgccccttccagaaccagctgtaccagcgttccgaaggctactttttctccgtggtataattcatgggtttccggaattgctgtcaagccgttatggatggcatgtgcccctgccagaccgccgctctcaaatccgattcctgaaagataagtatttgcctctatgatatgttctactgccttcgtgcagatattttcacggacagcaagtttcgcgtcaatcccctcatcaatcaaagtttcatagcaaagttcagccagggccatggccgcgcgtgtgatctttcctcccacacagttggatgcgtcagactgctgacaggctctcgcttcaaagtaagttgccagagcatctcccataccggctactaaaaggcgttccggagctttgctgacaatatcggtgtccaccagcaccatgttcgggcttgccggcagaaacaggtacttttcaaatacaccgtcatccgtatagatcacagacagtgcactgcacggcgcatcggtagatgcaatggtcggcacaatgatgactggctttttcatgtaataagccactgcctttgcggtatcatggatctttcctccgccgattcccacgatgacttcgcttcctgccttttcacacatgtccatgacacgattgatctctgtcatacagcactcgccgttaaaagcttcatatgtaatcttggcatctttttgtccttttgcgatgaaaggctccactctttttcttcctgacggacttgtcagaacaaaaaggttggttccgtagttttccgcatatgtacaaaggttttccatctcaccttttccctggatataacggcttggacttgcaatgatacttgccatagtaatttcctccttgaatcctttgattcttatgaatcatttgaaaagttaaccagcgtcaatacatttactataccatgaagttcctttcaaaatccaccgttgaatgttaaaactttgtcacacagactgctgatatgcttttgattttttggtcttcctatgttataatgatttttaacataattgttacaattatattacgtcttttttacaaaggaaggtttcatgctgaacaataaaaagataaaaacaaaatccatcaaaaatgccgttaaaaaagcaaaacatcagcctaaatatatccgagcagtatttgaacgggtcaccctgcgccttgcttttcttgccctccttggaagcatactcttttctgggttccgtttttatcagggccggcagcaaaatgtgaatgccgcaaatgaagtcaaacagcagtctgatcataaaaaagcttccgcacagacaaagaaggagtcaaagcagtggtatgactaccgtgcggttgcacatgctcttggagagatcgatggtaaggagtatacgaactccaaagatgcgtttttaaattcctatcaaaatggtttcagggtttttgaagctgacctgatgcagactacggatcatgtcatggtcgcaaggcattattggggaaaagacctgagtgatccgaagagcaagggcggcaaacctgtttcctatgcaaagtttaaaaatattaagctgtacggcaaatacacttctgtctcattgaaagaactctttgaactgatggacaaatatcccgatacatatattataacagacaccaaagacagtgatgccgcagccgcaaaaaatgatttctctgtcattgtaaagacagcaaaagaaatgaagaaagaataccttctggaccggttaatcgtacagatttacaatcagccaatgtatcacgccataaaacaggttcatccgttccgtcacttcctttataccacttatcagcagacggatgtggcgttcagcaaaatgatcaggttctgcacttccaacggcattgaagctgtcactgtccctgtgagcagtgtcaatgattaccggatgaagcttctaagtgacgcaggcctgtattctttcacacatactgtcaacagtgtatatgaagccaaagaatatatgaaactcggtgtctacggggtttatacagattttctgacaaatgccgaggtagaaaaatgttctttttctctgaagacaaaagatttctttgataaacttcaaaacggcaaataatcctgcaaaaaggactggcgcactttttccgtgtgccagtcctttcatttcgtttacgtaaattcttacagcaaagatttatagattgcaataatatcttctaaacttgcatcctttggatttccaggtgcacacgcatctgcggccgctgactctgaaaggaactgaatgtcctcttctttgacgatttctttcagatcctgtggaattcccacatcgatggagagctgtctcaccgcgtccacggcagccttcctatattcttcctgactcatatcttctgtgccttccacacccatggccttggcgatgtacttatatttatcccctgtggcatcagcgttgtattccatgacagccggaagaagaatggcatttgcaacaccgtgcggtgtatcatagactgctcccagtgaatgagccatggagtgtacgattcccagtcctacatttgagaatcccattcctgccacatactgtccgagagccattccctctctgccctcttctgtattttccactgcaccccgcagattctgtgcgatcagttcaatcgctttcagatgaaacatgtctgtcatttcccatgcatcttttgtagtatatccttcgatcgcatgggtaagggcatccattccggttgcggcagtcaggcccttcggcatagaggacatcatatccggatcgatgacggcaatgaccgggatatcatgggtgtctacacagacgaatttgcgtctcttttccacatctgtgatgacatagttgatcgtaacctcagctgcggttcccgcggtcgtcggaactgcgatgattggaacagacggattcttagttggcgccacgccttccagactccgcacatcttcaaattccggatttgcaatgatgattccgacagccttggaagtatccatagacgatccgcctccaatggcgatcagataatctgcacctgactccttaaatgcagccacacctgtctgaacgttttcgatcgtaggatttggtttaatgttggagtaaacctcatattcgcatcccgcctcatccaacacgtctgttactttctttgtaacgccgaactttaccaggtcagggtccgaacagatgaatgcctttttgaagcctcttgctccgacttctgctgcgatttcccggaccgcaccttttccgtgataggacgtttcattcaatacaatacgctttgccataacaacctccttgagatacctttaatttatcgtgattctttcattatcagtttacctccgggcggaacaggcggacaagtgacacatttcccataatgtcaaaaaagtgacacttccctaaaagtgttactttttaaagtcattcaaaagttctgcaagttccggaggcagagccctgaccagaagctctgccatgtcttccgtgctccgcttcattccgccggttacccactgaaccgtcatggcgatcgatccccggcagtacatttccagaaggaatttgatatccggcgggatctctttctgatatttcttttttataatatccttgtaaaattcatagataaaatcaaaatcatgctggagcagtgagttatgatcctctgatttaaaggccgccgtgaagaagcagcgctctcctttgataaattcaaacttcttgatcagtccttccctgagtgtaaggctcacacccatctgccggaaagatacgatggcaagtttatcaaaataccagttgatcaaatcatacttgtccttaaaattcctgtaaaatgtctgtcttgtcacatcacaccgctctacgatctgttttaccgtgatccggtccacaggcgtaaaaaccatcagttccctgacggcacctgccagtttgtattttgttttttccgatgcatccatgaaactcacctcatttgtccgccagtgcttccctcaaaaaaactcagctgtgtaatgacgcaggactcggcttttctttccgttatcttatcgaactgatccgtctttccgcatagcatcagagcctccggccggtactgtgccgcagtttgatttacaaattctctgctgtggccggcataacagtacagacagcctgccggacaggtatcataacttccgatatcaatactctctgcgcatccacactccggcctttgatttttatctttatccacagaaattttcattccaataagtttttccacaagtcctctgtcaatacagctgcccggtctgatgccgaagccggtaaggtcatagtgctccgcacaggtcaccgcagtcataccatgattttccgcggaggtccctgctctctgagcaaattgaaagacttcttcttcggtgggccggcgaattccctcctgtgtcatccgtctgcttatcttccggtacatatctaaaaaactgatcaccgcctgttttgtatatccctccagggcttctgccatggattcaaacgtatgaatatgccattctatagaataatctttgctgatcagcacaggatcatagcgccatataacccgctcattcccgatcttttcggacagctcctgaaacaggggaatcaattcttttttcttatcgggcattcccggttctatatcctttccgtatccattgagtgtaaattgaaaataaaatggatactcgtaaagctctcctaaatacttcataaaattttcaggattctttgtccagaacacgatacagtcaatgttttctctggaaagcagaattttgctgacttgttttggattcaccggattcctcacgagaacaaagccatcccgaagccggttgatgaaccattctccataaaaagccggaacatcggtccttctgctgacactcaatatcataagcagtctccctgtcagattcattaccactggttctttcactggcttcattgtaccacggtttcccggcagattccatattttcttcttgacaatcaaaactgtaactggtaagattacaatacaaactgtaactcaagtaattacatatttgataagactgagagggatcaatatatgaacagcgaatttacgatagcagtccacgcactcgtttttttaaaccataaaagagaaagcgtatccagcgacaagctggccgccaatatctgtacgaacccggccagagtccgaaagatcatgggaaaactcaagaaaaaggggctgatttctacaaaagaaggggtggtgggaggatatctgtttgacctggacccatccaaagtaactctttatgatgtcagcagtgccctggatgttccctttgtctcttcttcctggcggagcggcggcagcgatctgccctgtctggtggcttccggcatggcaggcattatggatgatatttacggcacactggatcagttatgcaaagattatttgaaacaagtaaccattcaaaccatcgatcaaaagatcttcggttcatccacagtaaaggagaatgaaaatgaaaaaatatgacgcagtgatcattggtttcggaaaaggcggaaaaactttggcaggcacgcttgcagcaaacggaaagaacgtcgctcttattgaaaaggatgctgacatgtacggaggaacctgcatcaatgttggatgtatcccatccaaatcatttgtgacgagcgcagctttttctgcaaagcttgattcttcttttgaagaaaaggcaaagctgtaccggaaggctgttgaaaaaaagacaaggctgacagatgcattaagagataaaaactatcacaaggtcgcagaccttgagaatgcagatgtttataacggaactgcttcctttctggacagtaggcatgtggccgtggctttacaggatgaaacactggaattggaagcagatcagatttttatcaatacgggagcccgcccgtttgtccctccgatcgagggtctctcagacagccgccgggcatatatcagtgagactatactttctttggaggaactgccaaagcgtcttgtcatcatcggcggcggctatatcggcatggagtttgcttctatctacaccaacttcggctctaaagttactgtcatccaggacggggaagtatttcttccgagagaagaccgggatattgccgatgctgtcgcagaaagcttgaaagaacgcggagtaagacttctgctctccacaaaaataaattccgtccgtgatgaagagactgaaacggttgtgtctgtggaaacgcctgagggcggtgaaaaaatttcagcggacgccgttcttatcgccactggacgccgccccaacgtaaatgatctgaaccttgacgctgccggtgtggaattgacaccccgcggtgcagtcaaaacagacgaatttcttgagacaaatgttccgggcatctatgcaatgggcgacgtagtcggaggacttcagttcacttacatttccctggatgatttccgcattgtaaaatcacagattctgggagataaaaaacgaaccataaagaaccgcggcgccgtaccgtacagtgtctttttagatcctccgttttccagagtgggactgagcgagaccgaggccgctgagcagggttatgaatataaaattgcgaaacttcccgctgctgccatcccaaaggcaaatgtcctcggacaaaaaaccgggcttttaaaagccgtgattgatacgaagacaaacgagattttaggcgctcatctgttctgtgccgaatctcacgaaatgatcaacctgatcaaactcgctatggatgtacatcttccatatactgtgctgagagatacaatctacacccatccgaccatgagcgaggcactcaacgacttatttaacatctaggagactttatgcagtatttaatttcatttttagaaggtatcgtaacctttatatcaccctgtctgctgccgatgctccctatctatatttcttattttgcgggagagacaacagaccgcccaagacacaaagccttgcctaatgccataacgtttgttgcgggatttaccctggtttttattcttctgggtgccttcgcgggaactctcggagggctgctcacctcacataaaatgattgtcaacataatcaccggactgatcgtcatcatctttggtctgaattttaccggagcgcttaacataagctttttaaacagtacaaaacgcagctctatggaaatgaaaaaacattcccttgcatcatctttcttattcgggatcgttttttccatcggctggaccccatgtgtaggggcgtttcttggctccgcactgatgatggcgtcgcagcagggctccatggcagaaggcatcctcatgctgtttctctactcaatgggtctgggcattccgttcattctcagcgccgtgctcattgagcgactgatgggagccttcagctggatcaagtcacactacggcatcatcacaaaagtttccggaattctgcttattatcgtgggatgcgtgatgatgttcggaatgatggaccgctttttatcattcttgacattttaggagggatctatgaaacaacaaacaaaactgatagggatcattgtcatactcattgcacttttagcaggcgcttttgtcctctaccagaatctgagcaaaaaatataaggcagataccgcttccaaagaaacatcttccggggatgctacagaaaaacaggaagctgtcactgccccggacttcaacgcagagaacgccgatggaaaatccataaacttcttttctctcaccggcaaaaaacccattgtgttaaatttctgggccagctggtgtccgccgtgcaaacaggagatgcccggttttgaggccatgtataagaaatattccgacaaagtcaattttgccatggtcaacatgaccgacggagcaagggaaacaaagaaaaaagcctcctcctttatcagaaagcagggttatactttccctgtttactatgatactgaacaggaagctgcctataactatcaggcagagtctctccccacaacctactttatcaaccgggacggagaaattgtttccggagccaggggcgctatggaagagagtgccctggaggcacagatcaaaaaactgttagaagaacaaagtgagcaagcccacttcaacgccccaacccctcactctttgaggggcttgacaactttgcgtgccagatgcaatttgccgcgggcaaataatttccttacgcatttgtgcacaacccgcggagcgtttttatttcatagggaaggtcgtagaactttcctatgaagtaaaaaacaaaaggaactgacttgtccattgtcagttccttttgttttatcatatagttctattttatttgcagttcaaaaattctccgagcatcttgatctcatccgcgaaaatacagtgtttgatctcaccgttccgggctttttcttcaaattctccgaagtccatccagagaacagaatccacttcttccttctgcagccggaactgttcttccgcaagatctgtctcatatacgtaaactgcactcagctcatggttatgaaacggctttccatgaaagatatcctttacgacggaatctctcattcctataaacttaaattcttccggctctgccgttactcccagttcttcggaaagttcccgcaccgcagtgttcagataatcatcccctgccgccatgtggcctgctgatgacacatcataatacccaggaaatgcgtccttttctttgctgcgcttttgcagcaggacatcaaatccgttttgtttcctgcgcaccagccagatatgggaagtcccgtggagatcaccgcccgtgtgcacaattgatctttcctttacgatccctgtaggtttcccgtccgaagtcaatatatcaaaaagttccatatcttcgccgtttagacaagcctgtctaaggcagtccccctgatagacaagcttcagcgaaaagaaaggtccattctcagccagcagcttaaaaaaaatcttgtccccctcccaaaggttcaggtccaaaatatccttcttatccacccattctaagaccccttcattgcaggcggtcaactcccccttaaatccgtctgccgtaaaaaggctgatgtattccatcggccagtcgtcacagagaaacgtaagaatacctctaaacttccaggacgtaagcttaagccccgtctcttcttttacctctcttaacaggcagtcctccgggctttctccgtattcaaaatgtcctcccacgccgatccacttgtccttattaacatcgtgttttttcacggtccggtgaagcattaaatatttctcatctttttctatataacacagcgttgaaaattttgtcttgctcatcgatcatccatcctgtttttattctctgtcaataacggaattctgctccgtttcctaattcccagtatcctgttttttccgctcccagctcaaaatgaagctttgcgatccccatatcaatctcttcaaatccatttttgacctttacatgggctgtaaactttccatccttccaccgaaattccaccggctgtgcattcagggcagacggggccttctcaactgcttccatcccctgcatgatccagtccggaatcttttcttctgtcttgagcatctgatctgcttttttcccttttttctttacaaaagaagagatcatcttttctttcgtcctcttatccgcctctacatatccaaccgtaatgaccgcctcaaggctctctccctgttctaaatcgcacacacagctgtccttcttatatgtactgcccacccagcatgtgccgagtccggtagcagcagccaaaaggaccagcttttcaccgtaatagcccagcttttcttttaaatcgggatcgtcttttctgcccgccattgcaatgaatccatgcacatttttaaacatgccgtagctcattttaatcttggaaatgttgccctcatctgtgatgagctgcagatggagcccctgttccttattgatttcccggatcatctgaaacaacggctttgcatctttttcccttatatattccggaaggtacgtccttctggaacatcttatgttgattgcttctctcgtattcatttctgcctccttatgcctgcttgaatcaaatcgtagctctccccgatcatgcgtttgatatcctcatccggcactgaaccgtcaagaatgatggaattccaatattttttgttcatatgaaaggccggcacaacagaatcataagtctctctccataccaagatccactccggatcacactttatattgacccagatatgtccgttccgttcaaaaataaaagcaaatgtctttttattcatctcatgtctcatgagtgtccagttgctgtcatgaaacggatagtcttcataaacctgcttcagtgacatgcagaattcaatcacttcttttcttgttctcataccccgggcctcctttccatagcctttttattataacactgattcttgatttttgcccggaaaaagaagaaacagacagaaaaatgctgtctgcttcttaatatttgctaatatttttttatcgtaaatgcggtcgtctgaggcggaatgcttgcggtcataaaatcagcatgttctacccgtacccggtcgccctgttttaagtccctaagccgtattctgcttccctggcggtccagaatcggagtattctctgtgactacaaaacggatctggctttccggttttccgggtattcctgtgtacaggaaaccgttgtgcagatcaacccctgccactctcccgtcggtaaccgctgtcccgcagggattgcttttcacaatgatcctgtatgctctggcctggggtggaatactttttgtcatagcctttgagatccaggcatcgaccgtcatgccttccttcagatccctggaagtaattcttttcccgtcgctgcagtggatcaatgtatgctcatccacaatcattacaacgacggactgaattctgctgtctttctgaagtctgcacactgttttgacgtaatctgcgtcacccgaatgcatgatattttcaatggtcccgccctggatattgattgtttctccctgatccgaatcccatatattttcacaaaagctcatgcttatacagttcctttttcttttatattatgcagaaatataattttgtgaagttatttactgtattttcctgaaaaatattcttccaaatacgcttttgcacttttttatcctgaatctcttttttgacatatgtaaaatattccaatgcatcctgccagtcctttgtactgaagctttccgcatcaattttattcaaaatccggcttatttctctgtctttctgcctgtctctgagttccgaaagatatgcacatctgcttttctctgctaaaaaatccaacagtccctgatctgccatcttctatatcctcccattctctgtatctccctgtacttttgtccgtaaagaacgcctggtgattaaagcagactttttttgagtattttcagcttttccatcaccaccatctgccagtcaatattctggtctttggcagacactctaacatatccaaacacacgatgttttcctgattccataaattcattcccccctatatactgtaggttaaaaatctactcctataaagtatcacaagaaagaatcaatcttatactcggagggtgtgccctgtggggatctttaagcttgtatctcatacactgtctcaaaaatctgctgtttcatccgttcaaaatcttctttcgatgacttctttggatatgtcatatttttcagcagcagagaggattgtccctgctggagatccggctgtatataatcaaaatcattgaggcagaacccggctctttcgtaaaatcctatccttctccttgccaagtctgttcccggctcttctacttccaaaaacactgttttttccgtattattcaaaaaatcattcaggagcattcccccgattccatttccccttaaggatgcatcaaccgcaaaatgctctataaaaacgaatgtgtcaaactcccacacggcgagaaggccatggatttcgctttcttgtttcactgtataaagctgatacgccgaacggccgagaaggtttctctgaccttcttcatttcttatttcacttggcggaaaagcctctgtcatcagttcataaatttttgaaaatttttctgcttctgccttttcccattgatagatatgcctcaaaataaaacctccataaaaaattcattcattttttaattaaattttattacaaaatcaatcaaatttatacagctgctttcatttcgcatactataaaaattgtttgggatactaaagaggtaataaattttaaaggaggcattacaatggcaaatatatctatgttagatttacagaaccttcgtcacttaatcggcggttttgacaccacacactgcaaaatgcaggcttatgcagaccaggcgacagatcccgctctgaaaaaattctttcagcaatccgctcagtcagcaatggacagtaaacaaaaattaatgcagtttcttaagtaaggaggaagcaaaatgttagatgataagacaatggtagccgatacgcttgccggcgtaaacggagagctgacaaggtacggcggaatgatcgcccagtcggaaaaccaggaattaaagcagacattaaaacagatgaggaaccagtgtgaaatgtctcaggaagagatttataagcttgccagagaacgtgagtattatgttcctgcagcacctgccactcaggaagaaatagatcatgtaaaatctctgttcccacaggataaaatgttttaagtaaatttatttaagaaaagcggcatccaaaatattaggtttgtgatcagccccttgtcaagtagacagatgaaatatctaaaataaagtgccggaaatggtcatgtacatgcatggccatttcctatgcacaccatttttctttatatttttcaatgcgcggacttttacataatatcttttttagccttcagtttcttcaatggataatagagattcagcctgctggataggataccatcatttgaaaaaacaatagttttatcctttcctttgattgcatcaaagaaagccttctttgcggtatagctgctgttggagaaattgatcatggcatcttttatgtctattctattatttccattgtttatgacacatttttgatttaaatcaccggcctgatcagcaatccttacaccagatatctcatatgctcctgaaggggccttagatgaaattggaatattaaaagtatatttacctgaaaatttgggcgagtttgaccattccccttgcctgttatttctgcatatactaaatataagattgaactgaaaaaagcaggtgatattttgactccagtctccaatcaaactgagcttctgaatgctgtggcttccaaagaaactcacattcaggcagtctcagatttcacagtctccaaacagatcactgtccgctgttccctgacactcactggctgttccgatgaatgtccggtctccctttataaggatgcttcctttccctctgctatgtttcatgtttcagaaggaggcagcctcacccttcaaaacattgtgttagacggtcaaaaggaactccattccggcagagatcctatgaaccgttccttaatattgatttcgggcggtacgctcattctgaaacacggtacagttctccgaaacaaccattcctatacagaagggggaggcgtttatttttcaggcatcggttcccttccaaacaatttcctgatgaccgaagattcgcagatttcgggctgctcctccagactctgcggaggagctgttatggccgctgtcaaacatcccgatgataaactttcaatcctgggacgcgctttgatcacccacaatactgcggcccacggcgccgggatctatcttcgctcttttgaaaagcgggcgggaagcatcctcaccgtttctgactcggcagccataactgataacattgccctgggatgcggtggcggcatcaatttctcaggcttccgtgaagatgctgaaataccttcttccctcacagtgtcaggtaatgtgaggatctccggaaatgcctctgcttacgggggaggtatttacttcttcggctgcagtgaggaagatcagctggatatcgaaaaggactctgtcctctctgaaaacagtgcaaaagaaaacgggggaggtctctgcctggtttcccaaacaggtgcctcagttacagtaaatgaatgttctatttccaaaaacaaagccgatggacagggcggaggcatttcactcactaatcgttcttcaaaaaaatctgtccgcctggcactgatgaattctgatataaagggaaaccgggcggcttcctgcggcggaggcattgtttttagtgcaggcagcggagaattttcctttcatcttacagacagcaggatttttgaaaatatttcttcttctgacggcggcggtattgccatgagttcatccggcagcggcattgtcaatgtgtcacagacttcattttccagaaacaccgcaaaaaaatccggcggcgggctggcctttctgtctgagtcttcatctaaagcaaaaaatctctccctgacatcggcagagtttatcaaaaatcaggcaggatcaggcggaggaatctttcttgattccaaagaaggcgctgcggatgcaaacctatatgactgtatcatcgaggacaatacggctcgttttgggtacggcggcggtatcctgtcccatggctttggcaatattgtaagtttaagaggcaccacacggctttcacaaaaccttgccaagaaagcaggagtcggtatctctcttgaatgcggcagttctcttattcttgaggaaggaccaaatttatatgacggctttttcctcaaagatgcggatactcatctctacctgcagaacaccctccatcccaatgcatgtatccgtcttgagaattccgaatatatttctccaaacaaggaaggaaatccaatcgtcatctgtgcccctttatccgaatatttcggtcttcagccttcggacgccgaaaaatttcggatgccgtcccacgggtttaacggctgggaattccgtctaaatcctgaccgaacttttgtcctgctggctcccgtccgtttcaggatacgctatgagaacctgttggaatcctcaaacaccaacccagttttttatacgacagattcacctgatctcatcctgaatcctccggaagaacttccgggccttgccttcctcggatggtatgacgatccattcggcggaaaacagataaatatgatcccccatggaagcacggagcattacacgctctatgccagatggaaaccagaacccgtggggttaaagtcccttccccttttcaggaaacgattccctctttctcttctgagcaaaagaaagcattaaaataagggagtaaatcacagtacgatttactcccttctccatacagtttatgatcgaccagaaattatatatccgttttttcctctctgctttgtcttgtagagaaccgcatccgcattattatacagcgagacaaagtctgttccgccccagaatatcattttcacggatatgccctcgtataactgttataaactctttaatagccatatccctaaacacatggccgaaccggccgttggcctgcttaaagttatcaatatccaacaggaaaaaggcatacatggcaacctgattttttgacaagaccttcccgatgcacctttctgcagcattggttttgaataacttttgtttcttcatgccggctcctcctcccagtcctctgtcccgacactataatccttctttggggcatatatccttcagacagcatacctcacagtgtggctttgtccttgcagtacagatatcccttccgagaaataccagcctgtggcagaagtcgcttccttcttcgggaggtatgatctcccagagtgccatctctactttttttggatctttgatctgatccaccagtcccatgcggttcaccagccggatgcagtgagtatccgtgacgattgcaggttctccgaaaacatcgcccatcacaaggttggcgctcttacgtcctacccccggaagtttcatcagagccttaaagttatccggaattccgccgccgtattcgtctctcaatattttcatacaggcactgatatctctcgccttacttcgtccaagcccacacggcctgacgatcgcctctatgtccgccggatctgcttctgccagagcattcacatccggatatttttcatataaatcctgaacaaccacattgactctggcatctgtacactgtgccgccagacgcacgctcaccagcagtttccatgcctggtcataatccaaagtacaccctacatcaggatactcctttttcagcctctctatgatctccaacgctaatttgtcttttgtcatattgtactcctctatttctattataacaaataggcatttgcgaaacgccggaatccgcataaatacggcattctttttgctacaaaacaactcctcaatgatttatggtaaaattgagatgtcaaataacaattagcaatatcaccaaaaaaggagttgcacctatatgataacatacaaacagctttctttggcagatatttttaccgattgtcaaaataaattgtcccggtgtctttcgtttctcattctcacgctgccaccagcagacctcgtaaacatcttctttatccgatgctcaaggccctgttattacagctcattttctctattccaagacatctctcttgatcgtatttctcaaatactcttgctccttcatcttctgcaaatattcttccgtgatctcggcatatccattcacaagacctggcatcggcgtaaccggatgatacgtaaagagcataacctcctcgtcggcctgccgcacgatctcatcaataaccgtcgaattcgcgaacgtcgccgtgtagaccttccagatccggtcagtgttgtgaaactgcagcccctttgttttttgttacaattcctttaattcttttttcttttgatcgagataattcttccatgctttgtcgtcaagaaattgattttcatccggatgtttcagcatgtattcgtgtttattcagcaaatcaacgttagacgtatgatttcccataaacagatcaactttctggttccttaccttctccagcgagtgcagataatcttttctcgcttgaaatccagaatctccaatttcgttcagataatccgactgaagggtgttaaagccaaagccgccataatatcctgcgcgttttctctcttttccgtccgtaatatcgaagaaacacacgatacaacctttcgtgtgtcccggaaccagataaaattcaacggtcgtattgccaaatgtccgtatatccccttctttgactgcaacgtccacatgaaataatgtatccatgcaattgccgctttcctgaatcatagtcaattccggatgttcccgaaacatttttacatccggttcacccatgtagattttggttccgaacatgtttttaaaaaaatttacagcgccaaagtgatcaacatggccatgcgataaaataatccattttacgtctgccggattaaaacccatttcccaaattgactgtatcagcactgcctgcgctccacaattcccagcatcaaacataagaagaccttctcccgtgtccacaatatgcacgcagacccagctaccaccaacatagtataaatttccataaatttgaaatggttttacatagcgcaattcctgattaataaaaaattttcccgtctttttacctgcaattctgttccgatgctcctcataatccttataatctgattttattgacattttacttttccttactgatataaattccatcggctgctggccggcacaagccgcagacccgtggggtggtctgcagccgtataatctgcaagtatattagtatgatgtactgttcgcgaaaacaatgcacaacaggaagtacagtttcattataacatctgctataattccactatacttcctactatgcggtttattttttaactttagaagaggaatgttactgaacttacagtaactactgcgatcaatatgatcagcaatggcccgccaatcttgacaaagtcggagaatttatatccggccggtaaaatctgcatgttgacagctgttccgtaagatgttgcaattgccagattcgaacacgccgcaattacgataacccacggaaccggactgattccaagaccaagcgccattgcgatagcaattgggctgatcatagccgccgttgcattgttcgacataaaattcgtcagtacgcttgttaaaactgcaattacaattgtaagaactactacggaagcgtttttccctccgaaaagattcagtactgcgtttgcgatcaaagctccgccgcctgatttatcaagtcccgctccaagtccgccgataccgccgattgtaatcagtacatcccaaggaagctcttcataagctttcttgaccggaatacattttgttccaagaacgataactgcacctaacataccgataacgccgattgtaaaatggcttttaaatggttcaaatccactcgccacgaataagaaaatgcacagaagcattgtaaatactgaaatagctcctttcttgccatccgccggatcatttgtgcttttttcttcaactgccggggcatctgcatacatgtttcccacattgaagtccggactttccggtttcagaactttcttcagcaaagtatatccgatcgtcccccagaagacaacctgcacgatagatgccggaagcatgatttttgtcatatcaaacattccaagtccatctttatatccgtcatatccctgaagcaccgcgttcgccgcaagctgtgatgtagacccgaccagcgtacatgcccccccaatgactgctgcagttcccgccgggaaaataaccatcttagatcggatccgtccgtttgatccagccgctacaacagcgatcagaggcatccagatagctactgttccgttattgctcataaacgctgacatcaaacagcatacagcgcttgctgttacgataaatctgcgttccgtctttgctaaaaatgaatttccaattctgtcgccgattttctgagccatgccggtctcaaagagcgccgcgcttacgatacacatcccgacgaccattgcccagccaggagcgctgaatccggcatatacttccgaaagttccatctgcggaatcagaattcccattgctacggaacttcccatagccacaacgctcattggcaatttattccacatgaacagtacaattgtaattgctgcaattataattgctataatacttgaactcatagttttttctccgtttccccacatagtttttcttgtaacttaactttatacactcatatataagagttcagccctttattatggcttcttatacttctgcatactccgcgtctttccacttcggatgatcatataccgacctgtctgctacgaacggccatttctttccctctgctactgccagacagcctttcacacacatttgagccattttaatgaccgcttctcttgtctgtgccgccgaatgagggcttacaatcagatttgggcaattcaaaagcggatcatctgtctttggaggttcattgcagaatacgtccgttcctgcccctgcaatttcacctgctttcaacgcctctgtcagatctgcttcgttgatgattccgccgcggctgcagttaatgatcagtgccgttttcttcatttctgagagctgctttctggaaatcatatttctggtttcctcggtgagaggcacatgaatggatactacgtcactgattttcaaaagctcttcatagttctcatagtactctgcgccgtaaccttctacctgttcttttgacaaaaacggatcataggctgctattttcattccacatccttcacagatctttgcagtttcacgtccgattgccccaagtccaagaatcccaacgttcttaccttccagctcaaatgcttttttagctccacggatttcccagttgcctttgcacatttccgtctgagcttccaccagatttttggaaagtgcgaacatcatcgccaccgcatgctctgcaacgcttctgttattggctcccggtgtgataactacagggatcccatgcgctgtagctgtcttcacatctacggaatcatatcctacgcctgtacgcccgataaccttcagattcgggctgttctcgatggcatgtccgtcacattttgcaatccttacgatcagagcgtctgcattcttcatttcatccagataattgtttggatcctgattatctgcaacataaacatccgcgattccgtccagcatctgaagcccttccgggcacacggcctgtgtcattacaaatttcatcttctattcctcgcttctttctaatcttttatttagttcatacccttatcagcgttctcttttaaaaccctcttaagcgcttctacgccttcatcgcacagatagttgaatggccttctgcagtctcctaccggatatccaagcatcgcaacggccttcttaactactgtgttcggattcccatatttgaacactgcgcggaaacttgcgatagaatcctgcgccgcctgcgcatcttccagtttcccttctttgaaaagattgtaaatagaagaaagtacatgaggatatacattggagcatccggcgatcccgccagttcccccttcttttaatgccggaaggatcagggaatcatttcctgataatacgaagaaatctttgtcaagatcctgagtctgatgaatatatgctttcaggttctcccagtccccgctggaatcctttgccccgacaataatatctacgtctctggcgagcctggcgaccgtctgcggaagaagtttgttgcctgtgcgtgccggaatattataaagtacaatcggcgtgtccacatgttttgcaacttctacataatggtcatacagttctttctgagatgcgaccgcaaaacttggcgtaataatggaaagcacgtctgccccaagctcctccgctttcctgctcatacggatggtatctgctgtggaaatgcatccggagcctgcatatacaggtacacgtccttttacctgatcgatcgttgcttcaagcacttcaaccttctcattctcgcttaagatataaccttccccgttggttccaaacgggaaaataccatgcacaccgccgtcaatcagacgttcaatctgtgcgcggagttcctctgtattcatactttcatccgctttcatcggtgttaaaattggtgtgataattcccttcagttcaacttttttcatgatgcgttctcctttcaattttgaatttttatgaagcactttctctgcgattcggcacaggatatcgactgttccgaatccacctgattttgatattacctgtatggaatggcctccgcatttaatttttgatacaacaacgccttgttcaatttcgcatattggttcgatctgcgtacatccgatttgcttcatatatcccatcagcgtatccccgcccgtcatcaggatcgtaagatccagcccctggtttaccagttcgttgacaatgcagccatgcgcatctgagattctgaatctgacagattcctgttctatcttgtggtctttcagaaattgttctttgctgtcatccgaatcaaatgtatcaacaatcactttcttcctgcgctggcagagtcccgctatttcgcgtgtaaatgatcttccctgcgccgtcccataatattccggcatcagtttctgatgcattgtcagatggattcttgtaaatccgccgttcttttccgcatacgaaacctgctgttctgtaatcttgttcagacttccgcatgctacatacatcccgtcagtcttgtgaaatgccatctctccttgccggttgaaagatattttttctaccagacgatctgccagtcctgcgcaccccgccaacagcccgagagcgttcttctcaatcagctcgtccagtcggttatcaatgtcttctgtactgaccgtatcacatacgataatctccggttggtcttttgccagttcaggaatcttctcgcttctctttaacacctctacggcaacatcgctctcttttttgatgatatccggtatgtacgacatatttaccggttcaaatggatcctttccaaatacactgttttccagcaattcaccgtctatataatgagtcccgttctttgtaactctgtgaatttccggataaccgggaaggaagaacactttgccgtttcccgctgcatcggcgacagcttttacctcggcccctatgtttcccctgagcgcagaatctgtttttttgaaaataatctgtacttcgcgggcaatcgcccactctgtaatcttttttactttcagatacgcgtcttctttctgcattggccttgattcactgtcgatcacaagaacctctgtgtctggtctgatttcactattctccaactttgtttttgtgaaaacctgtgtgctgatgccacgttttttaaactggattcctgtatccaaagcaccagtaaaatcatcggctataatcaacagttttaccacgtcgttttcctcccgctattatttgttttctgcaaggcggatcgcataatcaatagaatttacaaggcttaattcgttacattttcctgttcctgcaagatcaaatccggttccatgatctacagatacgcgtatgattggaatgccaagcgttacattgacgccggatacggcgtcccatttcttttgctccttattatatttgaatccttctaccttaagcggtatatgtccctgatcgtgatacattgcaacgacaatatcataccagcccccgattgctttagagaaaatggaatccggaggcgtcggcttcttctccggaatatgaatcccttcttccagcgccgcatcaatagccggctgaatctcttcaatctcttccgtaccaaacattccgttctccccgcagtgcggattcaggcctgccacgccaatcttcggctctttaattctgatcgctttacatgcatcgttggcaattctgatgcactccagcacgcgttctttttttaccctctcgcatgcctgacgaagagaaacatgcgtggacacatgtacaactctcagatcgccatgggcgagcatcatggtgtatttgccggtatgtgtataatctgcgtaaatctctgtatgtccggagtaatgatgccctgccatgttaatggcttctttgcagatcgcattagttacagttgcatcaatctcgtttttcattgcaagctcgatcaccttcacaacatactggaatgcggcttccccacacatttttgaaactttaccgtatatatgctttttcatatcgaccagtttcatatcatagacgtcgatcgttccgtgttggaataccgcatcttttacattttctacagcatggatccggatttcattgcctttcccaagaaactccactgcgtttttcatgcaattcgcatctccaataatgattggcttacatctttcgtacacagccgggtctgaaagtgcttttacggagatttcagatccatttcccgagggatctcccattgtaattccgataattggtttcttttccatttctactgccctttctttgataattgttttatttcagaactctcaggtaaatacccctgatatcatccagtgataattctttcatgttatttaccaaaagtcttttttgatcgcttcctgcctttacaaggaaatcaaggtcttccatttttactccgaattcattcaggtctgttggaatgtttgtcactcttacaatgtctacaatctgttcgatcatatagtccgccttttcatccacatttttttcgaaaagctccgggaacactccgtcgcacaattccgcaagtctttccctgcaggcgtctttgttgaattccattacatgtgcaaaaaggattgcattggatacgccatgcgcaatatggtattttccgcccaatggatatgacagcgcatgtacagccgttgtaccgcttcctgtgatagcgactccgccatagaacgcgccaagcatcatattaccctttgctttcatatgatctgcatcattgtaagcttctctgatattatgaaagatcagttttgcaccggccattgcatacgtatcggaaaacgaagtcgctttttttgaggtaaagcactctactacatgggcaagcgcatccacgcccgttgctgcaatgatagattttggaagctttctgatcatctgcggatccagaaatacgtaatccggaatcatgttatcgttcacaattcctttctttgactgctcttccggaatggctacgatagcgttgcatgttgcctccgatccggttccgcaagtagtaggaatcatcagggtcttaatctgtttctcagcaattgcaggatctctcagaagatcttttatcgtataagaagcgtcttttaatatactgcagagctttgccgcatccataacgcttccgccgccaatcgcaataataaaatcaccattgtagcacgcgacctcatccatgactctttctacatcctgatatgccggttccggagtcaaattgtcaaatacttgatattcggccgttgttttatgaagtattttcgtcagtatatccaaaagtcctgtaagtctgatgcctttatctgtaaatacaataatcttctttgcatgttctttttcgatgattgcagctacattttcaatgcatccctcccctccgcagatatatgacggaattttaatctgataactcattttctttcctcctttgattcgttttgaaatattttgtgtttctttgcttttcttgtttaacatattacttcttaaaacctcgttattcaattgcacaatttcattttatcgttttattttgaaacatccagcttaatttttgttgcattttgatacattcaagtatataatgaatctatatgaaagcgaatatctcaacgataaaaatccattttttacaaaggggaaatccatatgcagaaaaccaagatacttgcagtagctccttatgaaggaatggcggatgccatatctgcaatcgcacagacaagagacgatatccgcatgacggtacagacaggcgatttggataacggcaaaaaaatcgccctcgaactggcacataataattatgacgttattatttcaagaggcggaactgccgaattgatacgttctaacgtcgagctcccggtaatcgatatcccgatttccgtatatgatgtgctccgcacaattaaacttgtggaaagctattctggcaagtttataatcgccggattttcttcgatcacaaactgcgccaaagtgctctgcgacctactgcagtatgatattgatattgtaacgtttaccaacgaatcggatgctctgccggcaatcaggaaggcgcagcagaacggctgtacattggctctttgtgatatgacaggtttaaatgcagccaggaagctggggatgaattctatccttctttcttccggaagcgaaagtatcacttctgcaattgatgaagccgtcaaactcgtggcgtcttctgctcatgttcacaaacagaaagatctgtttcaggctcttctgaccaatgaagaccgggaatttctgatttttaatccagccggagccttatggttttccagtcttccaaataacgacagcaatacagtccttatgaatcttgtacagacttatcttcgggcttttttgaaagtttcgggtcagacagtcaccagacagatccgcgataaaatcttcatccttacaaaccggcatttattctatgaagaccagaaatatacagcaataaccatccaacagaaacatgccgttttttccgaagaagactcagtaattactatttacaatcatttggattcgaactcagaagatttcgccgatgaatacaacggctctcaccaagtgggacgtacggccgatattatcgaagcgtatgcaaagagcacacagccggtactgattataggagaatccggaacagggaaagataaagttgcaaagcttttatattccaacagctccgggaattcttcccctttatatatcatcaattgtgaacttatgggggaacgaaaatggaatgccctgatcaataattcagattcgccattcgcaaatgtgaatacaaacatctatatcaaaaatccgggagcgctttcgaaaaatcaattggacaagcttttttcttatattgataattcagagctcgccagaaggaaccggctgattttttcgctgatcctgaattcctcagaaaaggatcagacggaaatatgtcgaaattatctcgagaacaaattatcctgcatgactttgaagcttttgccgcttcgagatcgcattcaggatctttcgagcattgccacgctttatattcatcgtatgaatgtcgctaccggcaagcagattatcggctttgaggcggaagctatggatttgatgactgctttttcatggcctaacaacctcgatcaattgcaccatataatcaaagaattggtggttataacccgcactccatatattacgtatgaaaacgtaaaagaaattttggacaacgaaccctccgccgatccttctgctgatatttccggtctggatcttaccggcacactgaatgagatcaatgaccagatcatccatatggtgcttacggaggaagccggaaataaagaacgagccgctaagaggcttggaatcagccggagtacgctttggcgaatgttaaagaagtgatttacagatacgggcataaataagacaggaagaatgcatcccttatacctctttttcacaatgattcaggctgatccaaaggatcggtaaaaaggacagcagattgctgatcatatgagctgaaaaaggtgcttttaagctgtgatgcttctcatacacgaagtaaaagacgttcccccacaatgctgcatagatcccctggatcacatgtctgtgacacagcccgaaaataacactggaaatcagagacgacttttctttccccatcggttttaatccttcgtacagaaatctgcggaatcaaagttcctcggtcgccgggccaatgacccctgccgcagctgcgtttactaaaagcgggcttttctcagcactttgatccattatgaatttgctgttatggaaattttctgtaagataaatagaaatgtattgtgtgagaaaaaagaaagaaatcgtaaataaaagaataaattccttaatacctttactctctgcaaaaacagtatgctggatggctatccccttgtcccgcagggcatttactctgtcgggatcggacgcgatcggtactaacgcatccaaaccttctttatttctcttctccatgacttcaaaccaatagtctctcatctgagggatctgttttctttttgcagggttgtctacatatagatcgtgacatctggagcaaaggggcgcagcattctcaatcgtatcttcatctccctcattctgaggaatgatatgatgtacttcaacaaatggttcctgacagatgacgcacctaaaacctgatcttctccttgcttcttccttaactttttctgaaaatcccattatattcacacctctgactttattttatagatataacgcagttctcttaaatcttttcctccgatatgatccgtgagacagtctccactgttctggaaaccaaacttctcatagaaggttctggctctcatattttcttctaaaacccagagaaagacatatgtatatcccagctcagccagcccgtcaactgccgcctgcaaaagctgtctgccatatccatttccatagtaatccggaagcaaatagagcgagacgatttccccaaaccccttaagactgatgaatctggaagcacagtaggaggccgtgccgatcatcttttcaccattcatcatgactaatgaaatcaattcagaattttgaattccttcacgccatttttctttatcaatgttatccagaaactcctgaggaatgatgcctctatatgtacttttccaactggccgcatagataccacagactgcatcgatgtcatcttcctcgtttaataacctgatctccatttaatatccccctatttcaaatgctttgtattcatggtcaaaatgatatcctaatttctctgcaagtgcagcggatgcttgattttgggcatcccagctcggatacagacctttattcagacattccagtatcagctttgctccacaagcataagccagtccatttcgccggaactcttccttcgtgtcaatctctatttcaattccttctctgtatcttgcataagaagaagctcctgctgcgagcgattctccttttaatacggcaattcctatgccgagctttttatatgtctcatagtcctcaaactgtgagaccagatcctgacaccatgcacttgatctgcatagcgcaaaaaggtctgcatcaatcattcgcagggtatatcccggctttaatgaattgacggcagaccttaaagtatctttatcaaaaatattctgttctttttttatggcataacgtgttactggttttgctctgtctccatactttttgacgatcagttctgcccattcctcagactgcggcaccataataataaagtcctggaaacagttttccggtttataagagactaaatcttcctctgcatttccggcaaaaaaacagaaatcaccaagaacagccatagcggactgtggatctgaagtattgtccacatagatgtctcccatgaccttttgaagacaggaccagattaaagtttccttccattctccgaacagttttctcgcttttgttgtgtcttccaatttgataggcatgccataatcctttctcttcttaaatattgcttgttgtctgctcattcatcccagtcttttatattatatttgacgagtaattcttttgctttctccaatccttcttcgtaaatatgtacagatttagagcgatggcttccctgatcaatcagcccttcttcctcaagatcatccaaggcatgaaagggataccctttccaggctttgttttcttctaatgaaaatctatcctggtggctgaatcttgttagatacattaaaagcagtgatagttcgttgatagcttcttttggagatgttttttcttctctcatcaacctgattcctccttacactagcggctaaataactgtttttgtcaaatcatacatcataataaactcttcctctgtctcatcgataattttaaagccgagattctgatacattttaaatgcataattttctttctgtactgacagagaagcctttttgtatccttttgattttaaaagagacagcatctcctgcatcatttttgtaccgattccttttcctctatactttttgtaaagggaaattgcaaattcgggagtcacgtcatctatattcccatatccggatatgatccgtgtccagactgctcctatgattcttccgtttgcttcggcgcagagacaatgatcgtgttcttttccaaagttctctatgtatatatttaagtctggttcatcgatgatttcctttggcagaagagtttccgtgcctttttgaaaaattgcctcatataaaaacttttttagataagggtattcatttgaatacatttgtctgatcttatattccatggcactctcctttaattaaattctttatagagtgaaatatggtcttttaattcaataaaaccattttttatataaaaattaaaagcgggaacagttctctctgtctgtaaaaaaatatgcgttacctgtttgcttttggcatattgttcaacggcttgtaaaaagtccgtaccaatgcatgatgcttcccattgaaaggccaatgagttcatcatttttaaacagacccaatgttaaagaattcctgtttcctattaaatccataatatattcatgcagttgtgccaagtcactccaatcatcattccagggctcctttgtaaaatctctgcaaataatgatttgatttcttctatgcttttaatatttaattcttttagttctttcataatagattttcttctcctctaaaacactggatttcccaggcatgtctaccgtccaatgacgaatcaattttctggtggaaacctctactgccctttcctcttcaatagtgccacggtctccacatgccccgtatgcccaaactgatccacaaccgccactttccgaacttcatatccttctccccccagcaccttcaaatcccgagccaatgtcccaggatcacagctgacatacacaatcctctccggccccatcttcaccatagtatcgagcaatgccttatcgcaccctttccggggcgggtcaacaacgatcacatccgcataaaccccattcttctcatactctcgtggcagtacttcctccgccttccccacaaagaacttcacattatccatacggttcatcctggcattcaatctggcatcttcaatggcttcctttacaatctcaaccccatagacctgctttgccttctgtgccaggaacagagaaatcgttccgatcccacagtaaagatcccacacagtttcatccccgcagagcccggcatactccaaggccttctcatacagaaccttcgtctgccttggattcacctgaaagaatgacagcggcccgatttgatacttcacattcccaatatagtcataaatataagcaggtccataaacctcttctaccttacttcccataatccggtttgtcctctcccggttgctgttgacacaaatgctggtcataccctcaacctcttttaaagactccaccagttcagaaagattcggaagctccttcttcctgccgttcaccacgagacataccatgatttcccctgtgacaaacccaactcgggtcatgatatggcgcaccaatcctctatgatttttttcgtcataaggctccacatggttcctctccatgtaatcaagaacctttttaagaatctcctcattgaccggatgctgaattgaacagtgggtacagtcaataatagaatgagtccgtcccgcataaaacccggtgatcagttttccagccttgttccgtcccacaggaaactgggctttgttccgataataatacggctcgtccattccataaatcggttccatgaaagagcctgcattttcaatcccgccgattcgttccagacagttttttaccttattaaatttatactccagctgcttttcataagacagatgctggagagtacatccgccgcacggacgtgcggaaggacatctgggctccacacggtcaggagacgggacaagcagtttttctactcttgcaaatccataatttttctttatcttgatgatgcgggcaaggactttgtcccccgcgacggcatcttttaaaaagagggcatagccgtctgcatggccgatgccctctccttcattgcccatatcatcaatttccacttccactaattgattctttttaaattccataggcacctcttatttcatcatccatgaatgaaaattaaatggatgattctctgatctttgtgtcaaacaaacgctggaaaccggaccattcctggccttcctgcttcttctcgatcacctctgcaaatgtctccatcttagcatccagattatcagcctggctcagtgcaagtgcttctgccaatgcaggttttttcggtgaaccgaattccagttccccgtgatgggacagaatacagtgtttcacttcgttggcaagctttacagggaatcccgggatctcatccatgagtttggaaagcttgatcgttcccatgacaatatgtcccactaactggccttcgtctgtataatcattttcaggaaatgctgagagctcctctgcctttccgatatcatggaacagtgccgttgtgacgagcaggtctctgtttaactgcggatacagaactgcatactgttcacataactttgccacgctgacagagtgctccagcaggccgccgatgtatccgtgatgtacactttttgcagcagaatgaatcttaaacttctttacaaactctttatcttctacgaaaaccttcatggcaagttcttttaaatacgggttctgaattctctggatcattgttaaaagctcatcaaacatttcatcgatatctttttttgtggatggcatataatcggaaatctggtattctccttcatctgccttccggatcatttcaatattcagctgattatttccctggaagtttgtgaccttccctttcaccatgatataatccatggcctcaaaatgtccgatggcattgttaagttcccatacttttccgtcgatcattccggttttgtcctggagcgaaagagaataataggtctttccaaattttgatgtgccggatgtctttgtcttgcacaaaaatacctccgaaaccatatctccttcatgcagctcacttatatatctcataatttaacctttctagggccgccttagagcccgcacctcttttactttccctattattacataaactgccccgaaaatccactggaaaattgccgtttggctcgtttacatgccacatattttatgctacactttttctaaatctaaaaaagaaaaccttctataaataatggtttttgaataatctgagggaaaaaatatgaatcaaaaagttttaaatacattagaatatgacaaggtcatcgaaaggcttaaagcgtatgccaccacagaacttggaaaagccgcctgtgaaaaattagagccgatgacggatgaaccggaaatatccctggcccaggaacagacacaggatgccctgaccagactttataaacagggaagtatttcattttttggagtacatgatctgggggcttctctgaaacgcctgaaaatgaaagggactttgagtgccggagaacttctggagattgccggtcttttggaggcagtaaaaaatgcactggcctacggtgcacagcgggatgatatggcggatgccgattctctggattctgtatttgagtctctggtaccgatggacggcctgttaaaggatatcagacactgtattatttcaccggaagagatcagtgatgatgcctcctccgccttaaaagacatccgcagaaatatgaaactgaccaatcagaagatccacagccagctcacggctatggtcagttcttcctccaacaaagacatgcttcaggatgcccttgtgaccatgagaaacggacgctattgtattccggtaaaacaggagtaccgcggacagtttaaaggaatgatacatgaccagtcttccagcggttctactctgtttatcgagccgatggcggtggtgactctgaacaatcagttaaaagagctggagggacaggaacagacagagatcgagcgtatattatcgcttttaagcgaacaggcttcctacgatatggatggtctggcacagaaccaaaagcttctggttctgcttgattttatttttgcaaaggctaaatatgccaaagactataacggcagcaaaccgattttcagagaagacggcgtgatcaatatcaaacaggggcgccaccctctgcttgaccctaaaaaagtggttccgattaacgtctctctcggcgatgcattttctatgctggtcattaccgggccaaatacagggggtaaaaccgtttcattaaagaccgtgggcttatttacactgatggggcaggcaggccttcatattcctgcattccagggttccagtctgggaatttatgaagaggtattcgcggatatcggagatgaacagagtattgaacagaacctgagtactttctcctcccacatgaccaatattgtctctatcattcagaatgcccatcgtcactctctggtgctgctggatgagctgtgcggcggaaccgatccggtggaaggcgctgccctggctatatccattctgacggacctgcatgaccggggcgtaaaaactatggcgacgactcattacagcgaactgaaaatgtttgcgctctcaacggacggagttgaaaatgcttcctgtgaatttgatgtagagacattatccccgacctatcggctgatgatcggcattcccggaaaaagtaatgcatttgcgatttcacggaagctgggactcgataaccatattattgtgcatgcatcggatcagattgatgaatcagtaaaagattttgagaccatactggctgatctggaaaagagcaagcagacgattgagcaggaacaggaagaaatctttgaataccggaaagagatcgaaaacctgagaaagagtctgaaggaacgccaggaaaatataaaagaaaagcgtgagaaacttctccgcgaggcccgtgaggaagcctaccggattatttccgaggcaaaggaaactgccgatgagacgatcaaggaatataacaatttaaagaagcagtcaggcaaagatgcaaacaggaaaatggagcatatgcgaagtgatcttcgcggcaaaatgtccagactggaaaaagatatggcatatcgttctaaaaacagagcgtccaaaaaacatgaacctggagattttcaggttggagatgaggtttatgtgaccagcctttccctgagcggcacagtccagacacttcccaactccaaaggagacttgtatgtacagatgggaatgatgcgctccaaagtcaatgtcaaagacctggagatcactaagagtgtgaaacaggtgaaacgggaaaatgcaagaaatgaagccagaaacagtgggcggactgcgatcaataagtcttccagtatccgtcctgaaatcaacgtccttggtatgacagtggatgaagccgtctcccagcttgataagttcattgatgatgcctgtctggcaaaccttggacagattaccgtcattcacggaaagggaacaggggccctgagaaaagggatccataactacttaaagactctgaaaaaacaaaaacggatctctggataccgagacggagaattcggtgagggagatatgggtgttacggttatcatgttgtaatatctgaccaaagtttgattttgtttttatcacatttatacaaattctcaacatccagttgacagttcgcagcggctgtgataaatttgtatcaacaattcgatagggatcgtgactattatagaataggcgagacctgaattataataaggcatgagttatgtcttattataatttaggtctctttttatatttgggggagggataaaaatggagcaggagtgctttcatgttaaaaaggtcttaaacaataatgtcatattttcaaaaaaccaagagggacaggacattattctcacaggccttggactgggttttcagaagagaaaaggggatccggtggaggcagaaaaaattgaacgaatttttatactgaaagaagaagctacaggaaacagactttcggagctgttaaaacagattcctattgactacttttatctggcggatcagattaaacagcatgcagaacaaaagctttctaaggaattaaatcagaatatctatgtgactctatgtgaccatatgtattatgcagtagaacgttttaaacaaggacttttgttccaaaatcagttgatgtgggaaatcaaacggttctaccctaaggaatatcagattgcgttggaagcgatcaaactgatgaattccactctcaatgtaaagcttccggaagatgaagccagttttgttgccctgcatattattaatgcagaacttaacggtcatgaaatccagtcagtcatcgatatgacaaggctgatcaaaggaatctgcagcattgtacaatatgagtttaaaatagactttgatgaaaattccttaaactatacaaggttcatactgcatttaaaattcttttcccagcggcttatgatgaatgagcctccggcagaagaagcatcctttttataccctcaggttcaggaaaacatgccggaagcatttcaatgttcccggaagatcgctttatatatacaaaaaagctataactacaccattacgaaaagtgaacaggtctatctgaccattcacattgaacggctgctgtcagagagcagaaagctgtaaatcataagttactaagattgtgactgcttcgggcaggcaagacttaagataaattatttcaatcttaaggaggaaacaacatgacaaacagacaaatggcagaagaaattctgcaaaaagtaggcgggaagcggaatgtgatttcttattcccattgctccacaaggcttcgccttgacctgaaagattccggcaaaatcgaccgggatagtcttgataagctggatggtattctatctgtgatggatgtggcaggacagacccagattgtactcggtccccaggtccagtacatttatgaagaactccaggggatctttccgcagagtttttctgcttcttcggaggccggtagtcagaaaaagaaagggtttttagggtcagctctggagatcatctccagcctgtttactcccctcattgacgttctgatcggcgctggtattttaaagggacttttgagcatcctcactgcatccggtattttgacggacgccagcggaacctatcagattttaaatgcagctgcggacagtctgtattattttcttccagtggtgctggcgatcacttgcgccaaacgctttaaaacaaatatgtttgtgtccgtaacaattgccggagcattattatatccgaatctgacggctctttatgatgccggaaaggctatcagctttttaggtattcctgtacagctgaccacatttaagagcagcgtatttccaattatatttgcgatcttactgctctcatatgtagaaaaaggcctcgcaaaactgcttcctgagaagatcagaagccggattgctccatttttctctctcctaattgtagttcctgtgacgataaccgtctttggacctcttggctctatgctcagtaatacgatagcaggattttacatgaacctgtatggatttaaccctatgattgcgggaggtttcatcggcgccattgctcaggtgcttgttattttcggaattcattggggattattcccgatcattttctccaacattgaaaagtttggttttgataccatcctggctgtatttggtcccagcattatcgcccagtcaggcgctgctttcggtgtatggctgaaaacaaaagatcaacggctgaaacagattgcggcccctgcggctctcatgggatttttcggaatttctgaacccgcgatttatggaattacattaaaatatcgcagagcatttgcggctgctatcatcggaggaggtatcggtggtgccgttgcaggagcctgcggtgccagggctatggctgtagccgtcgctgccgttccaaccttccctgcttacttcggtgccggatttaccgggtttgtaatcgcctattttggtgctttcctgatttccgctgttcttacttatcttttcggttttaatgattctatgataccggaatcagaacgggctgatgtaaatgtcacggcagatcatacagagctcagtacatccacatccaaagctgtagcaatcaaagtacatgcgcctgctgacggtacagttctccctttgaacaaagtaaaggatcctgcattttcctctgaggcacttggaaaaggtattgccgtcattcccgaaaatggaaaaattacagcgcctgttgctggaactgtggccgccgtttatccgaccctgcacgcatatggcattgtaagtgaaaaccaggaagaatttttaatacatatcggaatcgacacggtaaaattagatgggaaatactttaagtctcatgtaaagactggtgatattgtcatgcctggagatttaattgctgccgctgaaatagatgagattaaaaaagcagggtttgaccctacggtcatcattgttgatacatcaggcggctccgagagaaaaatgaccttactccgggagggatccgtctcttcccaggaagatctgctgctcattgaatcattataaggagatctatatgtttaaagaaaaaatgatccctctttatgctggaagtaatgattgctgcagactgaaacaaattcccggctgtaacaggaaccacctcctcgatccttctgtgatcgggaaggtggaaaagtccggagtttttctgacagactatgagaaagctcccttcacaccttttatggatctttcttccctgaggcttgaaatgggatctgagaatctggacatcacacaagagttggtagaagaaatgccctttttgatcagactttctgaccgctttatccctgttaccttttttcgtcttccaaacgggcaaatgcagaaaccggtgattttcttccacggcggaggcttcctcggaggaagtacgaaggtccttgaacatcaatgcagatttctggcagaacaatctaaagccactgtcatttctgtggattaccggctgattcccgaaaatccttttcccgcagccctcaatgactgcaaagaggttatctcttggatctgggaccatgcgggagaatggaatttggacagaaacaaaatcactgctgccggcgaaagtgccggcggcaacctggctgtttcatgctccctttctgaaacaggaaaaaaagtggcgttgaccatgcctgtgtacggtgcactggatttatcttatgccgaagatacggactactgggactattataaatatgaagtcatcccggaacactacaatcatgcaatgacaagactcaaccgctttcggattttaaacaataccattcatgatttgtacgcagtgaacggagaagacgtgaaggatccttcgatttctccgctttatgcaaatgatttgtccaacctaaaaaaagcagtaatcatcgaagccgaatttgactatttccgcttatccaacgatttatttgctgaaaaattgtgggattctggtataccgtgtgaggtgatccgttaccagggtatggatcacggtttttatgaccgcctgggattttgccagcagacaaaagattgtattatggaaatggcactacagatcagaaaactataaaagaataaaggcagcggatggtgtaatgatagtattatacctcacaccctttgcacatatagtccgcaaagatcctcatggcatctgtctgcgccgttcccgcaagctttgcaaagacaacaaataatttcctgggcggatccagaggaacaactttcacctggccggcctgaaagatccggaagttgctttttgccagcaggctgataccttcacccactgcaacgccgctgataatggattctactcttccggtccggacaacctcaggtgtgatgcctgcggattgttctcctgagaagcttggctggaagctgtttgaatgtgccggacatcccatagagccagtggtgatccatggaaaagcacagtgccggatgatcaaggtgacggctgtgacacgccggaaagatcctattttacaaacctgtatcggccccagcgaagaacatgtatccatggcgggtatccccacagaagccagcattatcggaatgatcgaaaaggccatgcccggacgtcttcagaatgtatactgctgttctgccgggggggggcaaatatatggcggtcctgcaattctgcaaaaaaacagccatcgatgagggacgccagagacaggccgcccttctggcattttccgccttcagcgaactgaagcacatattcctcgttgatgaagatgtggactgttttgatatgaatgatgtgttatgggctataaacaccaggttccagggagatgcggatatcatcaccatccccggtgtccgctgccatccgctggatccgtccaatgatcctgacttttcaccgagtatccgggatcatgggatcgcctgcaagaccatttttgactgtactgttcctttttccttaaaagagcggttccagagagcacagtttttagacgttgatcccagcccgtggatgtctgtacagaaggaacatgaggtgtagaatatgagacaaaaacgattattggtgggcataagcggggcatccggcatgccgttggccgtggaagtactgcgggcattaaaggcatccggaatagaaactcatttaatctgcacagacagtgccgcaagaaccctctcactggaaaccaatttagccttagaggatctccagggcctttcccatacagtctatgataaccgcaatatcggtgccgctccagccagcggcagttgtcccatggacggtatgatcgttgttccatgcagtatgaaaaccttagcggggattcacagcgggtacagtgacagcctgcttctccgggccgccgatgtgaccttgaaggaacgccggaagcttgtgcttgtggccagggagtgtcctcttagcaacatccacctgagaaatatgtatgaagtttcccaggctggcgccgtcatcctgccccctgtgctgagttattacaatcatcctcagtctgtggaggatatgacaaggcacgtggccggcaagattttagatcagttcggagtagaatttgaaggatttcagcgatgggaaggaaaatgaaatgataaagcagactttgctgaagacagaattgtttgggtatgaaatctgtgcccatgtaacccgtctcgatgagggcatccaggttcttatcgcaggcggaagccgcactcatattggcgcggtgagctttatggggtgtaatggaaatattcaaaccctacagtttccgggacataaggacggatatgtgagtacacgccgggacaatgccccctgggaaagcctgcatgaacccgtctgtatccaatacggaatccattatgatcgtctggaaaacgaccagataaaagaagtccttaataatagtattcataaaatgtaaacaacttaacgtttcttttagtcttgactaaaagattcatctatagtatagtgtacaaagattatatgcatataatggaaactattaatatttaaagaaaaaaaggtattgacatgaaaagacttttaattggtttattaatcacaacaactatattttccttatctacttctgccttcgccatggataaaagagtcaaggcatcaaaacattgggtttcgactaaggaaatcacggctaaagaagcaaaagcaaacaagaactggaaaaaaggttatcttaaaggaaacggcaaggggtatgtaacggcaaaccagaagcattatgttacagtcaaattgtgggcagactattcaacaggatgttggaaaacttcaaaaagaatatggggaaaaggcaaagtggagaatagtaccggatgggccacaaaaaattgctgtctgattgatttgtattcttcaagtgtgtattatggattttaataacaggctgaaacattatctggttttcgtgaccattataatcatatttgtctttggatcatctgtctattcttatgccttatttgtcgaaagaaataattcttcaatttctcaaaatagcagccaaggagattggctgctggctgacaattacgacagaaaaggctaccgttatgaaaactttctaagaaaaaaggattctttaaagattttaaaacaagtatatcaacatcttatgaatataaaaaatattgattattatgaaatatcaaaccaagattttatttatacaaaaaaatttcaaggcagcaaaagtttcattaatgggaaaggaaaccaaaaaatagatgatgtgctgatcacacccttgaaatctatgcaggtttcagaactctatgcaaaaagacaaaatctcgatcaaagcatacaaactggagaattttttaaacgatctgcatataaaaaaacttctaatcagatcgttcctgttgtggcgggtgcaaattataaacatatttttaagctaaattctattgttgaaaactcatatctggcaactaaaaatatccgctgtaaaataataggttttctagacaaaaaaacaaatgtcaaggttgatgaagaaattatcaatttagacaattatttaatcatgcctagcattaagctatcccctcaggatactctggattttaaacagattcttttatctgacaagtgtgaagggtatctacattatgataataaaaatgagtatcatcaggttgtccagcaagtaaaaagaattgtgaaagaaaccggctatgaatatatcattccgccagaagaaaaacataatctatataacctgtccattggacaaacttttctggtttttctttcatctgctttagcttttctgttggttatcaggaaattataccgagatcatatcattaaaacagaaaaggggctgtttttcgtcacatttaagaatcttacagtttatctcggttggctgttctcagcttttgtcatcagtcaggggattcttttagcactatacaagaaccaccagaatatatttattcgtacaaggctcactacggtgctgtttttcctggcggttggctgttacctgacattattgtctgtgctccgatggaagaaagaggattgatcatgagagaaaatttttctaaaggcgctatactgcttgcccaggctctgatcgctggattgattatttatgcattaattgcaatcgtattaaaagtaatgggtaagacaaaaacttttaaaaacggcgattggtttttgcagtacctctttactgtatatcttgtttttattggtattgtcacgggcatgtttgcttttgatgcctggagtctcaatggagcccataactataatctgattccttttatcggtgaagacctttcttacatcatattaaatatcctgttgttcctgcccatgggagtatttgtccccttaatgcagcacactgaaaaacgaagtctgaaaaaaacagtgctatttatattgcttttgtcacttttcatcgaatgcattcagtttttcttcgtgggaaggctggcagacattgatgatctgattgcaaatacccttggaggacttttgggttatactttttttaaggtttcagcttgtctggtcaaccgatataatagtggcagaaaatctggtcttggaacttattccattgtcctcagtgtcattactctgttttttggttttacttttccacctatgacctgttatggagatatgattcttgcgcgatttggaattccgatctggtcaggcaatcaaaatggaatcatttcgctggacggactgcattatagtttatttctctatttgatattaagccttctgggacttcttttagctatgagacatcccagtgatcttggagctaagaccggcaaattcatatcatacactgctattctatactttataattaaaataatcctaaatcttatgcaaacctatctgtaatggaatttaaatgtaaaatagactgtttggaaaatcattttcgattttccaaacagtctattttaaaattaattttcctttcccataagccttctccgatccatctcgatcaactctctggaggaatgaacatcggtcaccaggccgtccacgatcttatgcttcaaagccgcatacagacttgccgctttctctgtcccctctgtcacagcaatcacttccggaatccgtttgatctcttcaatgtttaaagagatgagctgcctgttccatttacagtctatcagttctccctctttatcaaaataattataagaaatgtcaccgaccaggcgtctgctgatgtcatccttctcccgattgatcccgtgcagataagattcggtcagctcaaaatactgaggtgaactgccgagtcccaccacagccagttccgcatttctggctttttccatgacacttttaataaagtgctgctttaaaagcatttcctttgcctcataggaatctaaaacaatgggggcatgcaactgaaggctattccccccgctgttctttgccatccgctcacacaccacattggcctggatctcccaccgttcttcccccaatcctcccgacataggtacaaatgtcacatggtcaaagggcactcccgatgaaaagctctcagcgatctggcgggtggtagttcccgccgtcattgccacatacttcacagtggacagctttctcgccacatattttgctgctgccgcacccactgtttttaccggattttcactgttttccacactgacgcacactgcctctctgatctgaaaccgtttcttaagctcctcctccagcttcctgtacgggtgaaactcctcgtcatggataatgatctccacaatcccgatctttctcgctttagaaagcagcttcgagaccagggaccggctcatattaaactttttagcgatcctctgctgggtccattcctcctcataataaagtctggtgatctcagcaagcatcctgacttcctctgcatctgccatcattctccctcccacactgactgtattccctctgctgacacgattatagcagatgtgcaggtcactcatccattccaaatattctcatggcagccatcacatcctgcttcatagcttccgtcgccgccagtgtgagacggtcataggccagatgttctcctgactgttttacaaagcttttagccgcgttccctcccgctgtattcatatatgtataatagttaatcttacagattccctcttttatggctctgcggtaattgtctccggataccccggagcccccgtgcatgaccaggggaatgccgtttttttcactgatctgagttacaatggaaagatccagctttggctgctttacataaagaccatgcactgtgccaaaggcaacggccaggcagtccactccagtgcgcttcacaaactcctcagccagagcaggatccgtataaatgttgtcctccccgggatcctcattgacatttgccacatgcccaagttctgcttccacagatactcccacactgtgggcagcttttacgatctctgccgtctccatgagattctgctcaaacggcctggcagacgcgtcatacataacagaagtaaaccctgcccgtattgcctccatgcaccgtttgaaggtgcttccgtggtccagatgcactgccaccggcacagaggcactccttgcatagtgcagcatcagcggggcaatctcatttaaatctatgatcgtatcatgactctgggcgtgctggaggatcaccggcctcctaagctcctccgctgcaccgattatggcacggattccttccaatgtggttccgttgaatgccccaaccgcctgttttttgttcttagcatcttctaataatccctttaaagtaactaacattcccttcctccctatcgtgtcagatccacattatattcatccaacaaaatcttttcagcctccgcattccagcatccgttgtgggcctcacatgatactgccagcttttcaaacagtggattctccctgccaagctccgcaaaatcttcaatggctgtcagcggcagatcgatctgtgtatagatcatttttttcccgcccgggatttccggcacatgcagagtagtctcgatggcactgcttaagcctccgatatgtgtcaccatcaccgtagggcggatccttttttgttccatcagcttcagggcgtcatggagatcctcattggtgcttccggtaaatcccaccagatgggtgtatgaataatgcacattatacatattgatcctggctgaaagcgattgatccacagggcccgcaaagaaattcatgcacccgtcttttcccagcacccggtccgcctgctcgatcaaggcttccaccggagcatagacaaacacatcatcatatcctctgccgccgttcaggtctttcagttcctctgccacatcccggcattcatttgcgttcacaaaatacagctcttttccgctttccggatcaggaaccagcattttttctgctctgctaagccgttctttggacatatcgacggcgacaatcttagaaggcccgttttccagctgcagggcatagtctatacactccagtcccatgggtccgcacgctccgaagatcacaagacttccctggggtttcactcccatacggtgttcatggtcttcctccgatgtatggtacattctccggtacccggcaatgatacaggccgtgggctccgataaggaagcttcaaaaaaggagtctccatcaaatgggatcagacagccgtgctccataacttcccggggaagaatacagtaggtgcagtctcccccataagtctcgtagtagtaacctgctgttttcagccggccgttttcagtgaccgtgggcagcaccgtaaacttctggccctcttggtataggtctttccatttcgcgcctgtttctatgatgactcctgacatctcatgcccgatgaccgaaggcctctctttaagatctggcctggctctcttgtgggctgccccctgcttagacagcttataagtggacatacagacgctgtcagaaatgatttttaccaaaatctcatcttcctttataggcggcagttcaaatgtatccagcctcaggtcctcttttccataaagtctgatcgctcgtgtttgcatagttagcacctctttcttatgattcaggtttatattgaaattcaaccccatcataattaccttccttcaccttcgtcaatcaaaagtgaagatatggaacaaatgttacagaacactctggttttttgtatttatttttgtgcaatcgtaaaatatgttccaaaacaatcagatgaattgacttcactttgagggcaggatagtatcaacacatgctaagagttcacgtgaaacttcttgtcaatctattcatatcaaggaggtgctaaccgctttatgcttacttatgttcttgggattttgatggtcacaatggcagctcaggccgccttcggctggtttcagatcaaacgaatgtaccagtccattgaagacctgaagaaggcctaccgccatacaccgaatcttctggccatcggaactgccaaatccggcctgaccttccgcccgggcgttatcgtgctggtcgtggtcaatgaatcagatgagattgtagattactatgaaatgaagggacggactgtattttccagattcaatcaaaaagatgactatatcggatgtcctgcctgctctgtcactgccctgatgaaacgcaaaaatgagaaggccgcttttgcctcagccttagaacaaattgccggtaaacggaaaactgctgtctgtccatgttaaggaggatatatttatgaatgtatttgtaaaactagccgaaggatttaccgggatcgtatccgcaggaggagaaaacctgatgggcctgatcaccggaattcttcccaatcttctgatcctgctcacctgtatcaatgccatcatcactctggtaggagaggacagggtcatgaatttctctaaaaaactgacccggttccgcctgctccgttacaccctgctgcctgtaatctcccttttctttttgaccaatcccatgtgctatactatgggacggttcgtggaggaagaccagaaacctgcctttatcgatgcctgtttctcctttgcgcacccgatcaccggcctgtttccacacggaaatgccggagaactgtttgtctggaccggtatcgcagccggcattacaaagctcggctactccactatgcctttggccgtgcgttacctgctggccggcgtcatcgttatctttattcgtggaaatgccactgaattcctcacgaaaaagatcatggcaaaaaataaaggaggtgcagcaaaatgaaaccatctgtaacgatcacaaaaggctccagcggatggggcgggccattgactgtctatgaaacggaaaccaggaaagtcgtcgcttctgtcaccggaggctccattcatcctctggctgaaaaaatcgcatcgctgcttggcgtcccggtagtggatgcctttaacaataaagtggaacccgacaccatcatcatcgcagtggtagactgcggtgggacactccggtgcggtgtttatccgaaaatgggagtcaagaccatcgatatccaccccatctccccgtccgggccactcagcaaatatattaaagaagataattttgtatccggcactacgctggactgtattacccaaagcggcgaggctgccccttctgaacctgaagtatccggacaggctgtcccggatctggctgaggctgagggaaaagaatcctcccccgcccctggaggaaatcaattttttaactttattaccagcatgggccgcggcatcggaagtattgtaaacgtattttatcaggcaggccgggataccctggacattgtcctgaaaaacattttgccgttcatgatcttcgtcagcatcatggttggtatcatcaactataccggcatcggcgatctcctggcaaatgccatcaaaccattggccggaagtcttccaggccttctggggttgtccgttttctgtgccattccgttcctgtccccggtccttggacccggtgcggtgatcgcacaggtggtaggtgtactcctcggtgtagagatcgggaaaggaaccattcccatcgcttattctcttcctgcactgtttgccatcaactctcaggtaggatgtgattttgtacctgtagcgctgaccctggcggaagctgaggacgataccgtgagcgccggagtacccgccatgctctttacgagacttgtcacaggacctgcggctgtacttgtagcctatctgttgagtttcgggctttacagttaatatcagatgttaaacgaaaaaacaatcaaactgcgaaacctccttcagcagtttgattgtttttagattctgttatattttttctttccatgcgctgataagctgcctgaattccggctcatcctgtagaaaatgaaactcctcattttcagggtcttcaaattcgcttaagatctttggaagtatagactttccaaaatggtccgtgctggacttactgcctgtgtatctgtacagcggtgattggcccggctcccattttttaagaatcgccggaaacatatctttcagtatggtgatacactgaccggtatctttccttgcgaatgcaagctgaaactgtgctgagtaagacccataatcccacaacccaaacaaacgcaccacctgccttgatatatcagcgatctcatctgcgtctttgggcctgttctcttcaaaggctatggtcatcaaatccatcagcgcagcttggatatcatttaatttcttcaaaagtctgctttccaggacacggcccgcatcctcccactgtttctgtttcatatacagccttgtccgaatctggttcttatccatcatggactcctccggcagctccttaaggaatatttctgctctgtcatattcctcccggtctatatacttaaagatcagcagagaacgcgcccggtccctgacctctgcatcagtgctctgggctgcccgttcatacagtttttcaatatcattctttaaatcagtacagtcctccttgtagtaaatacctaaaattccttccagtgtgaccgcaacattcaagatcaacggatcacaggatggatactcccgtactttttccattcccatatgaaatgcatgttccgctccgttactggaaacatccgctgccagttcattgagaaaatctgtgatttcctctttggttggttcttctttaaaggacagaagggtattcaggtctgtctccagtaaccgcgccaatgcaggaagcagtgtgatatccggataggacactgctttttcccacttgttgaccgcaggggcggaaacccccagcagagaagccatctgttcctgggttaaacctttttttatccgcagttcccgaatcatttcattgatcttcataagcccatctccttttctcttttcattgtatcagcccgatgaaacacctacaattgaatccttttttatttttcctcagaagaatttaaccaatggttaaaatgatgatcaatagaacaaagtgggcaagcccgcttcaacgccccaacccctcactctttgaggggcttgacaactttgcgtgccagatgcaatttgccgcaggcaaataatttccttacgcatctgtgcacaacccgcggagcgtttttatttcatagggaaggtcatagaactttcctatggaagaaacaaaaaaactgcctgtaaaaacagacagtttttcaaaattcttataagcgggtgatgggaatcgaacccacgtgatcagcttggaaggctggagttctaccattgaactacacccgcatctttcagacaagtaatagtatagcaaaactaaatacaatatgcaagaacttttttaaaatttcttaattcttttttattgcctgtttcacaaaatatgcagtcccaaggcttgccgctgatacaaaaagaaacagcacaggaaccgaaatccctgattctaatatctgtccgaacaaaaactgtccgggaggtatcgtggctgtcgccgctgccgttgaaaatgcactggtctttccgatcatagatccggggactgcctgctgcatgtaagtcaatgaaatcacattggacagcccaagagaaagcatgacaacaaagcctcctgccccaaaagcacatagattcatcagcgggctttgggacacaaatccagtcagacacataaaaagaaaggaaaccggcatcaggtaaagcactctgtggatcacagccatggaaaaactcttgggaaacacaccgatcagtactccccccgtgatcatcccaagcactgtgatcccctccacagatccatagacttctgaagaaaaacccagcacattttttacaaaatgcggtgctgctacggagaaaaccggaacaatgaacaggttggacagaccgtatgagaaaataatccttaatacgatcgtttgacatttttttaagtacaaaaacccttgatacatttcgttcacactgttcaaaaaagagatcttgtttttggaaccgctctttttttccggcagatgcagaaatccttccatcaatgctgaggcaaagaagctgattgcatttaaaacgacgatccaacgaatccccagaaaaccatacagcatccccgcaatgacgggtcctgcaaaattggcagcggatccgatctgctgtacaatgccgttggcccggtaaagctgttttgctgaaacagacagagggatggaggctgtcaccgccggtgaatacacagtactcgcagatgacaaaaggatcatcgtgacagctatgacagctggccggtcatgtcctgaaaataaaaaaactgcataacagcttataacaatgccgctgaagatgtctgtacagaccatgatcttctttttgctgaaggaatctgtgatatttccagctaccggcgcgagaagaacatatggaagcatagaaattgaaaggatcgttgcaaagatacctggactcccggttagctccagtacatagagagacatacaaaaccgctggatggcactgccgaacagagagatcatctgccccgccgctatgataacaaaatttgctttattcccccgtatgctcattccagctcatactccgtgcaaaccggatatgtgccgtcctcactgagtgtaagcttagcccgtataccataaagtgtctttaaattctgttctgttatcacatccgcaggtgttccctcaaacaccatctgcccctccttcattccaatgatatgatctgcaaacctggatgcatgattgatttcatggatcaccatgacaatggttgtttggttcttttggtttaattcttttaatagagagagtatttccagctggtgagacatatccagataagtggttggctcatccagtacaagaattcccgtctgctgcgcgagcgccatggcaatccaggccctctgcctctgtccgcctgaaagagaatctgcccttcggtctttcagcgataggatgcctgttgcctccatcgcccatcggatcacctgatggtcatgttctgtcagtccgcctacaggtttctggtaaggaaaccgcccgtatgccaccagttcctttactaaaagtccctccggtacctgcgggctttggggcagaactgccatctgtttagcggtctccctgggagcctgttttttgatctctgtaccattgataaagatctcgccctttttgggcttcagtatcccggccacagatttgatcagtgtagactttccgcatccattgccgccgactacgatggtgatcttcccaccagggatattcagattcagctttggtatgacgatggtctgctcataggcgacagtgatatccctcacttgaatcttttgttgttccattttacacccttacctttctttcatcaggagataaacaaaatatggcactccgatcagggagatcatgatacccgctggtatttccagcggtgaaaacagattcctcgcaagtgtatccgctcccaaaactaaaatactgcttaaacatgctgccgcaggaatctgtcttttgtgcacaggccccacgagacgttttgctaaatgcggtccgatcagtccggcaaatgcaatattcccggccacagaagtggcacaggcagccagacagactgcgagaacaaggaaaatctttctttctctctccacttgaacccctaatcccatagccagctcatcacccagatccatcacatccagcgttctgtttttgtaaaagacaatgaggatcagcacaatgataatgggcgcagtcatggcaacatacatccagctgctgccccacaggctgccgccaatccatgccagagcctgattatagtctccttttgacatgttcagctgataaagagtgatcagggcattgattcctgtgttgacaccaatacctgccaagatcatttttacaggcctcacactcccattatccctggccagaagataaatacacagaaagcttataaaagcaccagccgctgccgctatgggcatgagcagaacagtgccaaagcccagtgccgtataatagctggtgctctttacagaaatcaaaagcacaaccgctagtgccgcgcctgcattgataccgatgatcccgggctctgcaagatcatttttggtgacactctgcaaaatacagcctgagacagataatgcagctccggttagaaccgctgtcactgctcttgggagccgcagatcaagtacagcgatattctgcatgccgtcccctttgccgaaaagcgtcattacaacatcttttgccgtcatggagtagcttccatacattaaggctcccacaaacacgaccagaaacaagaacaccaccagggccactactgtacgctgcctttttttcatctgctttgctcctttctaatcagccacagaaatactggcacacctaatatagaggtaaacagccctaccggagtctcatatggctggtttgccagacgcgcggccaggtccgcccataccatcagcacacttccgcctaagaaagacaacggtatcattcttctgtagtcattgtcgaatatctttcttatcatgtggggaatgaccaatccaacaaaggcgatatttcctgcgctggccacacagacggcacaaaccggaatcagcagaagaatcgaccaaagcctgatcctttcaggacggacacccagtcctgtggccgcctcatctccaaggctcaggatgttaatgctgcctgccagaaagaaaaacagaatcaaagaaatccctcctgcaaatagtaaaagccacacatgaccccatgtgatagacttaaatcctcccgctacccaaaacgcaagctcctgtgaacgatttcccagaatcccgatcagggaggataacgatagaaaaaaagttcccagggctgtccccgccagcagaagccttgagacacttaaatttgtcgttcgcaggcaaaatccaagcacaagaatcccgccaagaaaagcacctatgagggccgatgctgtcaaaccaaaaagaccggatactgccggtattacacttgcagctgccacagccagggacgccccctgcgtcattcccatgatggacggctcggccagaggattcctggtcactccctgcatcacagcgcccgcactggcaagcatccctcctgtcaaaacagcggcgatggccctaggcagcctgacttccctgatcaattttatatccagtgaatcccctcctttaaagagcgccgaggccaccgtttcaaacggcagcctctttgctccaagggaaacagccagcagcactccagttatcaaaaggataacggaaactgcggcaaacacagaaacccttttactcattcatcttctccattaaaccattcacttcatccaaaaatgagagacgcccgatggaactgtatccctgattaaagtaagggcttgcgggaagctctgccacatgtcccttcttcacggcaggaagttctttccacacagagtttttctttaacgctgccatatcatctttggttcctatggcaagaatataatctgcctcaatggacgccagcccttcatatgatactaccggaaggctgatatccttctgctccggcagtcctttcggtctttttaatcccatatcttcatataaaatacttcctatcccggccttgtcatacacaaagatctggcctccactggcaaggatggaaaggtagcttttattctttccgtaggattttttgatttcttttcccttttcccgggcctttttcttatagtctgcaagccatgcttcggctttctcttttttctgcatgatatcggctaccttgagcacatcttctttccagtctgtctgagccagcttcagcattactgtaggagccgctttggaaagctgctgatacattttttcctgtactgaggaaataataatcaggtcaggctttaacgcaagaatcttctcaacgtccattttgtcctgcatactgtagcccaggatctcagccccggatagcttcttttctaaataagacggaaactttgtatagtcatacgcatctgagttggcggttccgactacagaataaccgaggatagagaggatatcactgtttccgctgatatcaacgattctctttggatctgcaggtatttcaacctttcctttggcatctgtcacagtgatggtttttgaatcctcttttttatctgtctgatctttttttcctgagcatcccgccagcaatgctgccagggctgccagaactaaaatgactgtaatgaactttaatttttgcgttctcattgtacttttatcctttcttcctgtatactatctttagttagtttcacctaacgacctcgcaacgtattgtacctaaccccgacccgcttttcaattgatttttattttattcatccatttgaataaatctgacactcaataaaataactcagaaaggaatccatgaaatgaccataacctccagtaaagctttccgggaggaagtgctgtaccagctttcatttcagccgtcctcccagggacactgtactttatatcaaaatgtatctgcaccggaaagcgggtattttttattttattcccgtcctggttattatgagcttggaatcgcagattatacgatacctaaggattttcagatccagtttgacaatccggaatctcttttgaggtttggaaccgtatataagggaagtacaaagttccagctgaaaaatcagcaggtatcatcctttactccttcttctttttttgtggcagaaaaaaatctgaaaggaaaacaggcctggcatcaggggcagcattttcacgggacagagataaccgtccacaaagcctttttggacgagattgtttccgtgactttccctgattccctttccctgagtgactttaaacaaaatcatacttaccgctatctgccccatactgtcatttccgttatccaccagctcaacagcctgtctgtctccggccgtctgtctcctctttttctggagagcaagatcctggaatgtcttgcacttctgacagaggaagtcaaaaagcctaaggataatatgtttcagcaccagcttgattttgggttgatacaaattggaaaaaaccgcagcttcaggcttacggtctcagatatacaggccattcagaaggcccacgatattttgacggagcaggcagttcatcctcctaccattgaagaactgagcaagaaggtgtttttaaaccagcaaaagctgaaggctggttttgcgaagcattatcatatgaccatcggggaatatacaagcagcctgagaatggcaatggcggccggccttctctctgccacagatctttctgtcagtcagatcgcaaaaagaacaggctaccggtacagcggaaacttttctaagaagtttaaaagttattatggtgtaagccctctgaaataccgccggtcccaataaagcttgaaattaatgaggtttatctctataatatttcaggaaaggaaaatttcatcatttattacacaaaagaaaaagaggaggatttaactatgataaacgcttataaagcgtattggaaacgctatttcgattttaaaggaaggacatcccgttctaatttctggtgggcaatcctgggacagtttattgtatcaatcgttgttggttttcttgcaaggatgttagatacaaacgctgttaactcgttgtggtcactgatcacttttatccccggactgtcattgaatgtacgccgtctgcatgacgtagaccattcaggttggttggttttgcttgcatatataccgatcattttatttatggtcagcttaaccttgacaaccgcatccttgctgatgaatgcggaagctgcttccggaacaagaaagagagaaaagctacaaaacttttctctctttctctataatgtcagatactctatgattgtccttgatataatctgcagcggcaacctggaagtaacaagaaattccttaatagcataatcatacttcgtatatcctactacatacacatctgaatattgatttaactctgatcttggaagacatgtacagcttaccacataggctttgttttctttggcaaacttagccgccattcctaactcaggcgtactgttctttaccgtgaaaattataaccagatcatcctctttaaagattagattggatcttttcatatgttcggaatcccgcatgatccagacattatatcccagcagctgaagctgcatttcaaactcttccgctaccaggactgtagctccccttgccaggagataaatcttctttgctcttttaattctttttaccacttcaagaatcgttggtactttcagattttcaatagtcttttgacattccagcatagatttttgaaaaatggcattcactatcattgcctcctgattaaattcattcctagcagaaattctataacgcagttctgagatgccgtcaaacccgctctttcttatagtccgggagactgtagcgggagatgtatagctttcttctgccatctcgctaatggacttttccggtatcagttcttcattgttgttaatatatgtaattacagatttttcggcatccgtaagtgtcttccactgatcttcttctaaacgaattatcataagattttacctcctgctactatgttaacactgcagaacctaaggaagcaaaattattctacaaatgctactctataatcttctttaaaatctcttccttctttggaaataatggaaggattggtggtcactccacagataatccccatctcatttgcctctctgatctcatcaacatttgcagtatctaaaaaaaatctcattgtttttcctccttattaataggtacatgctcctccggtcagatttaaagactgcccggtcatatattcagaatctttcgatgcaagaaacaagaccagattggtaacatcctggtaagtacaaagtcttccgaggggaatgttttccttgaatctcggcattacttcttccggtgttatatgcttctttttagcataatcgttgacctgtttatcccacataggagtcaggataacaccgggacagatacaattaacccgtatattttcctctgcaaactctgctgctatcgactgagtgagcccccggataccaaatttgcttgcacagtatgccgcgtattgatttgttcctttttttcccgactgtgaagaaaaattaataatacttcctccatgccccagcattccttttaccgctgcctgacagcacagaaatgtaccttttaaattaaccctcattgtttgatcccacacctgttcactgtcttctgccaaaaatggctggattacggaaatacccgcacagttgacccagatatccaaggacctgaaacattttgccgctttctccgctactgccatgactgcttctttctctgatatatctgccgccgccgcatctgccctgcctcctgctttccggatttgttctgccgtcttctccgctgatgctccgtccagatcaatggccagcacattagctccttcttgtgccagccttaaagcgcatgcttttccaattccgctccccgctccagtaactgcggctgtcttccctttcagtctcatggtttttctccttccttctcaattactaaaaatctgtaatgtgtttttctccataggctgccttccagtcagaatcaaatgtctccagacttgtatccgtcagcggatgttttaacatatcttccataatctgaagaggtacggtagcactgtagcttccgctcaaagcattatcaaaaacctgcttcgtatttttaaaagacgcagccaatattttggcagatagatgatgttccctgaagacctttgtcagatctgcagccgttttgatcccatctcccccatgatgatcaatcctatttacataaggggccacaaagtctgcacctgccatagccgctatgagtccctgcttagccgacacaaccgctgtcgctgtcacttgaaattctctggattttaattccataatcgcttttattccttcttttgttgctggaattttcacatagaaatttttacccagctcatccttcatccgctttgcttcctctatcataccttctgccttatgagccgttacctgggcatgcagcatctgatcttctcctataatgcttctgattttttttaaagtctcaaaaaaatctgattcttctctggagatgatcgatggattcgttgtcactccacagataggataataccctgccgcttctttaatttctgttacatttgctgtatccaataatagtttcataaactgcctcctttattgattatcttgatacattaattataagaaactgagaaagaaaaagttttctcaacagtaagcttcaaaaattaaacaaacaataaaaaacagcgaggctcctgcctttttgacatggaaatctctctggaaacagctaaataatattttcaaaatatgtattcatactgctaagtggttaacttcagttattaaaaataaagagacagcgagggcaatcgctgtctcctttttaacatctgtttttctgtggagaaaaactatcaggtgttttcatatataattagaatgtgagaatatttcggaatttatccccttttattgacgattccagagcatcttttatattttctgccggatagactccactgataaacggttttaagtcaataactcccccggataccatctgggccgctctcatgaaatctctgtcgttggaattagctgttccaagaatctgcacagattttccatgtacccagtttggatcaaacggaatcggttctgccggatgaatagaactgtacagcacaattttccctgcattactgacacacttaaacgtatcttctacaactgccggtatcggtgtcgtgtcaaagattacctgggctttgatgcctccagtcagttctttcaccttctgttctaagtcatcctttgccggattaataacggctttcgctccaagggatttagccatttcaagcctttcttcatttacgtcagatacaatgactttcgcacctctttttgtacagacagcagtgtgcagcagtcccataataccgcagccaataaccagcactgtatctccgagtcttacctgtgctgtctctacactgtgcaccacgcaggatacaggctcaatgatacacgcttcttccggagtaacgttactatacttaaacaaacagtctggagaaaccagaagatattcactgaatccgcccatgcctctataaggaaggcccggaagatgtgcactgtggtcaaaatgctcacagctctgttcatttccggtcttacagtaataacagcttctgcagggaagtgttacccctacaaccaccttatccccaacgctccattcgtcccggttgacttcgtctcccatctcttcaatatgtcctgcaatctcatgtcctccgatgaaagggaactctactttgttgactcctgtataaaccctctgctcccatgtgcagattgccgctgcatcgactttaatcaagaccttatttcctgatgccgaaggccttttgcactcttcaatttccacctgctttttatccgtaaatacggctgttttcattttgctgctcacaatcattcctcctgtcttagcctaagatacctgccagccctaataccccgccaatgataacaagaatcagcattacataggtagatttcaattttttattttttaataaatataaggtcagcaatgtgattcccaaagggatcatgccttttaataatttatccagaacatctgcctgaagagccagcttggtagctccaaccttaatgttcatatgggattcggcagttacgtaatttgctgtcaaagatccaagcaccgtagctcccataatggatgccgctgagatcagctgtttcattttacctccgccgaggattgcctcaactccggtttttcctgtcttatatcccctcatatacataaagtaagcgatgggaagcatgatgcctgccattaaagctgcaaatgcaaaagctcccataacatttccgcctgaggcaatactgatacctacagcaagaagaatcggctgcagcgttccctgccacagtgtatctcctataccggccataggccccatgaggccggttttgacactgttgatggcatcatctgtaatattggcaccgttggcgcgctcctcttccattgccacgaccataccattgataattcctccaaaatgaggctctgtattataaaatgccatatggcgttccataaacttctgctgttcttccttattaccaggatataatttctccggaagatgagacatagactgaagaactccgctggcctggagacgttcatagttataatttgcgtgtgaaaaaaaggtccatttccagaatgccttcagcacgtcttttttacttaagtggattttcttctcttctgccatttctattcccctcccttattcaaaatcgtcatcaaactcatcgtcaaaaccaccggctgttgctgctgccgtctgcttttcctctgccagagctactactccggtataaatataagcaacgatacctgcgatgatggcaatcggcatagtatccagattcaaataaacggcaatgataaatccaagcacataccataacagaattcccggtttgctgattgctctcagattcatggcgataccgatggccggtagtagccctccaatgacttccaatgcttgaatcggccgcccgctcagcgcgttgataatgtttgtaaccatctcagacccaaagtaacagcccagggctaccggtatacatccgataacaaaagcaaaaacttgaggcggtacaatatgcagaaatttagccttcttcatattcccttcttctgccgctttgtcgatcatatgtacaaagaatacatctaccgtcatatggatgacccagatgattgttcccaaaagaccaataggtactgccagtgcgatagctgctgtcggtttcacttctgctgccatggccagagccgttcccagtgtacctgccagaccgggatcagtgggaggtgcccctcctgctgaaatataagcgatgaatggaagctgtattgccgcgcctatgatggcaccctgaaccggatctccgagaataaatcccactatgacaccagataccagcggcttttgaatgattgtgcttcccagacaagtcagccacggtgttccattgattccaaggtaatacacgattccgatgagaaccgcctgaacaactgaaatactcataatttttccacctttctttttcttaatatttacgagagtcttacctcttttttcaacacagaaaatgtcataataactttgctacatcaacttttgcatcttccgctataatctgaatttctgtacggcacccgctatcaacaatcttctttagaaactcccgttcttcttctgaggctgaaatgtttttataaaatttctcccgcccgctgcctgctcccataccgccaatatttaagtgtccaaactggattccctgcttgattaacattaaaactgttttaggatacttgaccagaataataactttatcatcaggcttaaatccttttttaagccttgccactgccttctgtactgtaaatactccaagacctacatttccgggaacagcattttttaatacagtcttcatgaacggatcagccgctgtttggtcatcaatcaccataattttgttggcacttgtaaagttcagccatgaagtcatcacctgtccatgaatcagtctgtcatcaatccttgtcaatacaactcccttcatttctattcctcctaaatctcatccatttctgtgtcatccagcatttcctcatactgcttgtgcaaaagaaccaccggctgatttccggcctcctcacatatgtcagccagctcatctaagccgctttgatctctcatcatcacagcctgtaccaccattcccatgctgactcctgcgatcgctttaaaattctttgtgtccgccatgcatttcatcaccatattggatggactcccgcctaagatatccacaaatcccagcactccgtccccatcgtccagctcttttactgccatcctgattttttgctcaagctcatctattccgtcaccgtgatacagtccgatggtcttaacctggttttgttctccagcgatcagttccaccgcgtttaacagtccttctgcaaatcctccatgggctgcaatcaaaattccaaccatttccgctcctccttttcttttataaatccattataacagggcaggactgaaaatgttttcttgttaaggctggctctgctgatgtatatcagttgaaatataggagaaatgaatgtttttgcataaaaaaagagtgtggaaacccaggatttcccttttcacactctttttttgttatctatttatttactttttttacaatttatatatacatgtcaagaaataaaatatataatgaaattgctgtcgattctttccagctgaaaggaggtggcacagtggaatacatacttcgttttcttatgtcagtcatatcatctatagtgaattactacatccataaatggctggatcatagaagaaaagacagttaataaaaacccccggagaccagtcctctccgggggtttttctgtcacagtggacatacttctattttcttactgcttttatgataccctttttagtaattattgtcaacagtcattttagtccatcctcaaagattcaagtaatcaatcagcgttcttgcaatgatctgcaatggaagcctggatacgatatcaaagtcctcgatggtcttgtttctctggttatatcccaggacagacaagtctgaataatcttctaaatctgtctttggcaggcagcagcaggtcaccacatttgcacctaccttcttcgcattctgggcagtcaacagcagctccggcgtactgttctttatagaaaaaataatgatcaggtcaccctgcctgaacagtttatccgactttttcataacctctgaatctgacagcatatatgcattatacccaagcagctgaagctgcagttccacatctttggcaatccatgcggtagaacctcttgcaatgatataaatcttccgcgccgtcttaataaaacgtactaccttgaggatcgtctccgctttcagtatttcgatggttttcatgcactctgtgacagacttctgaaaaatttcgttgacaatctctccctccaccatatcttctatctttgcagaaagtttatagcgcagctccgagagaccgttatacccacacttcctgacagcccttgagacagtcggaggagaggtgaaactcttttcggcgagttcagtgatcgtcagctttaaaaactgatcttcatgttgattgatatactctatcacctgccgttcggcttctgtaagcccgctttccagttcttctgtaatctcaactatcataacctatatttcccttctcacgttgaaaaaactgattgtctgtgatatagtaaatatatagtaaagagcagctgtcccaatctgggatggccattataaaagtacacgaaaaaccaccttataacgaccaggtaataagggtggtttttcgcttttctaaattaatgacatatcatatatatgaatgtcagtaatgccagaagaaacattccaaaagacattaaatctttaaagtcaaaatgtttcatagccaccacctccattctatgtagaatgaagaccatccaccctatagcagctgctcatcttaaatgatacaatattttttggaaataatcaacaaacacaaaaagaaccttgtgaaaaattctacacaaggttctctatgttttttaatctctaacagatctccgcccctgccggcatatctttttcaggcacaaccaaagccagttctcctttttcattttctgcacagagcagcattccctcagaaagcactcctgcaagcttagctggctttaagtttactaagaccatgacttttttgcccaccatctcttccggcttataataggccttgatcccagaaacgatctgcttcacttcgcttcccacacgcacctgggagcaaagcagcttcttggactttttgacttcctcgcaggcaatgatctcacctacctggaactgcatcttaccgaattcgtcaaaggtgatctcctcttttggctctatgtcgatcacaggacctgctgccgcctgtgcctgcttattcatcagctcttgcgcctgtttgagcacctcttcttcatcaagccgcgcaaaaaggatctcaggcttttctgtcactttcgtaccgcttttataatgaccaaatgtagtcagatcctcaaaccttctgggttctgcattcagctgttttaagatcttctccacagtctcaggcatatacggctccagcagggccgctccggttaagataccttccaccaggttatataataccgtggcgagacgatctttctttgcctcgtcctttgccagcacccacggcatggtttcatcaatatacttattacagcgcttgaatacattaaaaatctctgtcatggcatctgccaccttgagcacgtccatctttttctggaccttatctctggcaccggtaaccacagctttcagctggtcgtcaaactcatcctcaacacccttatcttccacgactccgtcaaagtatttgttagacatggaaatggtgcggttcacaagattgcctaaggtgttagcaagatcagagttcatacgctcaaccatcagctcccatgagatcacaccgtcgtgttcaaacggcatctcgtggaggacaaagtaacgcactgcgtccacactgaacatctcggccagatcatctgcatacagaacatttcctttggacttactcatctttccatcaccctgcaaaagccatgggtgtccaaaaacctgcttcggaagcggaaggtcaagggccatcaggatgatcggccagtaaatcgtatggaaccggatgatatcttttccgatcagatgaagatcagcaggccagagctttttaaactgatctgtgctgtttccgtcacaatcgtatccaatccctgttatatagttggtcagggcgtccagccatacatatactacatgtccttcatcaaaatctaccgggattccccacttaaaagaagttctggacacgcacaggtcctgaagtcccggaagcaggaagttgttcatcatctcattttttctggactccggctggataaattccggatgagcgttgatatagtcaatgagcctgtccgcatatttgctcagtttcaggaaatacgcctcttccttggccggctgtacttcccgtccgcagtccggacatttgccgtccaccagctggctttctgtaaagaaggattcgcacggggtacagtaaagtccctcatagtgtcccttgtaaatatctccctgttcatagagccttttaaaaatcttctgtacctgagcttcgtggtccgcgtccgttgtgcggataaacttatcgtaagaagtattcatcagatcccagatccgtttgatttcccctgccacgtcgtccacaaactctttcggcgtcacacccttctcagcggcttttaattctaccttctgtccgtgctcgtcggttccggtctgaaaaaatacgtcatagccttccattcttttatatctggcaatactgtctgccaagataatctcataagtattcccgatgtgaggcttgccagatgtataagtaatcgcagttgttatataatatggttccttgctcatgtttctcctccattttcgcattatactgtgttttattatagtacatcttgcaaagatagtctatttttttcctttaaaaaatagtataatagtatctaagagattctattcagaaaggattcttatgcataaatatacatatcgtaagtttcttgcatttaccatggctgtcatggtggcattcactggctgttccaaaggatcggacaccgggaatccctccacagcgaaagaatcagaatccaccaaagacaaagcatcggaccggcagaagtttgactcctatttgaaccagcttttcaaggaacacgtcaattccaatacggtcaatctgcattatacccttgcacatccggaacgctacggcatcaaagccaaaaaggccgatctgggcaacatcgacttaaaagaccttgaccaggcagaagcccaatgtaagaaggagttaaaaaggcttgagagtttcaactataaaaaactctccaagagtcagaagcagtcttatgattatctcatggactactttaagcgccagcagaaactggcaccttacccctatcttcagacggttttaagccctactctcggctcccaggcccagcttcccgtgactttgtgcgaataccctttaagaaccagggaagatgtagaaacctacctttctctgctctccaaagtcggttcctatttcgacacggtcatccgctacgaaaaggaacaggtcaaacggggatatttcatgtcagatgcggatgccgatgccgtcttaaaacaaatcaatgattttacaagggccaccgaccacaattatatgatcgaagtgttcaacacaaatattgattcggtttcagacctcagcaccaaccagaagagaaattaccggaaggaaaaccgccgcctgatcttagaagaagtgattccggcctatgagaatctgtacagtgatttgaagaacctgaaaggaaacggaaagaacaggcagggctatgcccatttcaaaaatgggaagtcctattattctgctctcgcctcctataaaaccggctctgacaagaccgtgcctcagatgatcaaggccaccgaagcacaccttctttaccttcagacagagatgacagagatcataaaagaagatccctccatctaccatgcttttttagatttagatctgaataaatattcaagcaaaaaaccatcgaagatcctgtcacagctgaagcagaaaataaaagataagtatcctgctgccgccgaagtagagtgtgacatcaaatatgtccattcttctctggaagaaaactcaagcccggctttttacatgattcctgccatcgatgactataagaaaaatgtcatttacatcaataaggcgcagaccggccaggaatccctgtatccgacgctggctcatgagggctatccgggacatttgtatcaaaccacttatttccacagcaaaaaagaacatccgatccgttatattctggattatccgggatacagcgaaggctgggccacctacgtggagatggactcttacagttacctcgatatgaagcaggaacttgagccattaaagaagcttctgccggacaattatctgtacaatatggccttaagtgccagagtggatatgggtgttaactatgaaggatggagtgctgacgaggcagtcaaatatatgcagcagtacggaaccatcagtacctccagtatgaaagccctttaccgctatgtcatccagaatccggccaattacttatgctactacatcggttatctggagttcatggaattaaaagattattataaagagaaatctggaaatgcttatgatgaaaaagtttttcataaaatcatattagatgccggacctaacagctttcgtatactcagacagcgcatcgacgaaaacctgtaaatccgggtacgatctttgtacctgcaaaacacataagtttaggaggaaagattatgtcaacaaaagcacgctacacccatgacgaaattggaaaaggaaaaccgggattctcaaagacccgctccatcattgaggccgcattttacggcaacaacgtcattgaggttgtaaacctgaagcaggcatatgagcttgctaaaaattctccgggaaccattgttaccgacatgccggtctaccgcggagaagagttcggcctgaaaaaagacacaaaagttctgctgttcaacgacggctccgttaccggacgctgtgcggcagccagaaggatcgcgggaagtccgaacgtggatactaacgatctggatttaaaagtgatggatgcgatctacgatacacgcaaaaagaccatgtaccacgcagaagtctatatcggcttagaccctgaatttatggttaaggcacatcttctgattccggagggagaggaaaacatcctgtactcctggatgctgaacttccagtatgagtctgatgaatacaataaaatgtataaaaagtcccgtgccatcggcagcgagtctgatatttatattttctctgatcctcaatggagccatccggaacatccgcttgggcttacttacttcaacacccagaccaactgtgcagctttgcttggaatgcgctattttggagaacataagaaaggtactcttaccatcgcctgggcgattgccaatagaaacggctacgcttcctgccacggcggacagaaagaatatcgtttaagtccgaaccacagttatgttgcatctttctttggcctgtccggttcaggaaaatcaacactgactcacgccgtacacaataataaatatgatatcaccgtcctccacgacgatgcctttatcatcaacaccgaaaccggctcttccatcgctatggagcctacttattttgacaagacctcagactacccgaccgggtgcgaagacaacaggtatctcctcacagcacagaactgttctgccacgagagatgacaaaggagatgttgtccttgtcactgaagacatccggaacggcaacggccgggctatcaagtcaaaactctggtctccaaaccgtgtagacaagattgaatctccagttaacggcattttctggattatgaaagatcctaccattccgccgatcatcaaagtcaacggttcacatttggctgcagtcatgggcgctaccctcgccacaaagcgtactaacgcagaacgcctggcgcctggagtagacccgaaccgtctggtcgtggaaccatatgcaaacccgttccgtacttatcctcttgtggatgattacaacaagttccgttcccttgtaaaggaccgccatgtagaatgttatatcttaaataccggcgactttatgggcaaggatatcactcctggtgttactttgtctgtattagaacagatcattgagggcaatgcccaattaaaaccttggggaccgttcagcaacatggaaacgatcgaagtggaaggatatgtccctgattttgatgatgagacttatgtcaataccctgaaagcaagaatgacagaacgtctgaacttcatctttgaaaaggatacacaggacggcggatacaatgctcttcctactgaggcaaaagaggctctggctaaagtaatcagcgaagcgcacaaccatgtaaaataaaagtgaggtgaattcttaccgtgaccaaagagcagctgaatgacattgtggtaaaccttttccatgaaatatcttatcaggaggaaaaggcggtcatcacagaggagttcaaagacatttccaacaaagaactgcatatcatcgacgcgatcggaaccggcagtccgaagaatatgtcttccatcgcaaaggccctgaacatcacggtaggtacgctgaccatcgccataaacagtcttttaaaaaaaggctatgtaatccgcaggcgcggagagcaggaccgcagaatcgtttatatatccctctctgacaaaggaaaggaagcctttgaccatcacagtcagtttcaccgcgcgatgcttgaagatgtactttcccgattagacgaagaggaagaacgccttctgatacggatcatggaatatttccgggattactatgagacaaaaaacaattaaaaacggggggctggaaatctttccagctcccgtttttaatgcatcccggtgagaaatacactggccattactcctgcgaaggttgccagaagagcacctgccagggtgtatctggtctttttgatatgtacggccgagaaatagatagacattgtataaaaacatgtctcggtagaacttaaaataattgatgacatgactccctgagctgagtcagggccaaagttcttaaaaatatccaaaaggaatccagtagctgccgaagatgaaaacagctttgcaaagattaccggaagcacgtccttgggaatctttaaaagctgtcccaccggactcaatacggatacaagaagatccagcgctccggacgtcctgaaaatctgcacagctaaaaacagtgcaatcagggtaggggcaatttccatgactaccttaaatccatcctggactccttccagaaacggctgatacatttctttttttgaaatcattccatacaaaagtatcatgaataaaattaaagggataataatgccggacagcgaaacaatcacagtcacacccgccttattactttatattataatatatacatgcatcctcgtcctatatgccaaaaacaggtaagattgatagaactcattataataaaaaaggataccagaaacaaatcgtgctttcctggtatccttagattatttttggttacttcttatatttttttctgagaagcagcagtacggcacctgccgcacacacagccactatggcgtaaacagctgtatgtgaactgtctccggttctggaaacccttgattcagtcaccgatttgctggaagcttcagaagttttgacagtttcactgtcctctctgtagtaagaatcttcatcctcaggttcttcatatgttgtcgtggttgttgtctcacttgtgctagattcttcttcatcatctccaccgtaatatggatcttccggtgaaggctcatcatacatttccacagtctgcagttctccccctgcattcactgtaaacctcacatcctctgcaagttcgtagccaaacggtgcttctgtctcccttaaaatatattcttctccgggaataagctttcctgtgaccgcgtgtgcctcctcttcagatgtccactcttcaacgatcaattctgatccgtcttcctgaatctgaatgatctgaagctcagctcctgccagcgctttcttcgtcgctgcatccagcttgatgacagaaacttttgtaggtacattttcagcttcgacaactaccggtgtctctgctgcctgatcgttaattctgaattcatatttggtctccgcatccagattgtagccttccggcgcttttgtttcctggaaataataagttccaagcctcagatagtcaaatctgatctgaccctgtgcatcggtcttaagtccctgagccactaactctccgtctgccttgtacagactgaattctgctccttcaagagtccgggcgtcttcgctgctcacctttttaaggagaacggaacctcgttttgcttcatttgtaattgtaaaaccaaagttcagagttccattttcatctaatgagaaagtgtagtctcttccgtcaaactgaacctgtactctgtcggattctttctccccgatcactagtttgtgctccgctgcgtccagtacataatcgttcagagcctttgtctctttcagataataggtgttgccgtattttaatcctgcatcgaaagcaatccttcccttgttatctgttttcataacacttccaacttcattcttattatggtcataaagctgaaattcaacattttccaagggagcattatcttctgcatctgttttgtttaagataaaacgaatgttatcacctgtcaggccgctgttcattccgcttaatatcaatgggacactgccgctggttaccttggtctctttggcactcgcatcaaaggtaacggtgtttttaatatttcctgtggcagatgtgacatctgtgataaataagactttaaactggtgagttaaatccagtccatccgggaatgtaaacacaatcttacctgaaacatcatcataatctgaatccattccggaaatctctttattgtttgccgtcacatcgatcagctttacagatccctctctgtaagtcagtcccggctgaagctgatctgtaatttcggccttctgtttcgtaattaccgcatggtttttatttacatttacggtccactctacataatttccttttttataagaggtggttttttctacatctggcgtatagcttacatttacttcagcttttgctgtcagctctgttttaaactcgtctgcccgtacactcacttcattgactgcacttaccttttctggttttgtctcagcctttgtctcatcggtaacggtactcagtgtcatgtcatttttgtctgtcggaagcatttgttccgggaagtaaataatgatactatcaccgctgacctcatagtaaggctgatctgcactcttctctgtcccaagaactttatctccgtatttaaggcttccctctacgagtctgtggccttccggaagcttctctgtgacaaccatgttatgaatgtaaatgccctttgacctgagccagatcgtccagttgaattcatctttgctgctgttataacttcccttcttggaaacgaaagtctggatatttacagaacctgttcccgtaatatcctgtttgttaccatcccattcgagaaacacatggtttttaaaagaaacagccggtgagttcccatttgcattctgagtgaactgaagggctccgcccttaatccttgttgtatatgtgatcgtgcatttgttttttccaagatcctttatagtaaaaattaattcgtttccatttacctgcacatttttttcattcttgcccttataattagcattaaaagatccggcaatgtattcaagcccttccggaagcacatctttaaactgaatgtctccattcactgttttggttggattgttattgacagtgactgtccattttatggtattgtcatcttcaactcttgcaaaggctcctgactttgtaagtcccagctttcctttctgatatccgcttccccagctggaatcctcataatcagaaatgcttacatggtttccaaccgtcatgactgcagtatttcttacacttcctttttttacagccgcctcggtatccagccagatcttataattgacatagacaaagttattgttgtactttggatcaagtgttactttaaattctcgtgttgccgtatcatacgtatattcattttcacccggtgtacttcctgctgcctttgtaagtttcactgcattgccgctgccatatttcactgtgagctgtccttctgtctccatcagtgaggttccttctggaagcttatctgtaaatgtaaccggcagttctctgcccgctgtatcgtaccaacctttcagctgaaagccaagatacggcttctttgcatcgtcatcatatcctatattattggatgcatttttatctttccaaaatgcatatcttaccacccggactgaagcatcggctgaagcttcacctttactgtcccctgtcttaattgttacagtattagctgcaatggcagacatatcttttgcaccattggacttataatctgattcaaaaaattcatccgtaagctttgttttgtaagttaatgtatgggaaccattgctgatctttccgaacttatagttccatccattgtcagttagttccggatcggcagtttttgttccgtctaactccacggaaccttttacaaagacttgttttttatcaaacgtatctatcagggtgtatccttccagattattgtctcccttatccggtgtggcaatgaccgtccatgtgatggtctggtcttctctgttcagcgttccctttttcgctacttcagggcttttcttttccacttccggtttaaagtcagtctgatactcctgcccgaatccctcaagttgtcccagatcgaaaataattgtctcttcttttaactgatctgcgtccacgctgcagctaatctccatgaacccttcaatattagattgagtcagcgtttttggaaattttactgtgatggtcgcattgttgtttacggtccagttcggaacttcctctacagcgcctgcctgttgcttatttaatttctgcgcagcgccgctgagaccatctaactggaacacgttcggcattttcagaatataagtggatcctccctgaatggtttccttattcggaattttgaactcatatctgatgatcacattgctgtcttttgtgacaggatgagactccgtgaacggatttcctaaatggtctgtaaatgcaaatttagttaagtatttggtgaaattgccgtttgtcaccacaggatctgatccctgttttacggactttacggctgtttttttctgaattgctgtgacagatgcagtgctctcggcctttgcggcttctgtattactctctgttgcggccttttgctctgttgtgacagattctgtggccattgcagctgtttcctcagttgctaaagaagcctctgttgtagaagtgatctgttctgatgcagtttctgtttccgcctcctgtgcatggacattggtgaacgcaccattccctgcgataaatgatatcgtcagcacaaaagccgcaagaactgcaagactttttcttacctttttactcattttcatacccccatttattatttgaaacaaaaaagactgagtatccaacggattctcaatctacacataaataataatttatgaggcagctggctggcacgatcatactccctatacgatatagcccctttagctttgcgtcactgcctttcggcagctttgcctatttattttactctttctaaacctatattctcatcatatacaaattgtctctaaaaatcaagtgcttttctgaaatttctcgatgatctttgcaaagagaattcctacgatcgtggaacaaaaggttgcaacaatggccggcgcaacaatcgcggtcggattcacacttccgtactggcttcggaatacgatgatgttgaccggaatcagctgtaaagatgaaatgttaagaatcagaaacatacacatttccctggtggcgacacctttgtgcggattgatcctgtcaagggccttcattgccttgatccctgacggtgttgcggcccatccaagtcccagaagattagccacgatattcgtgctgatgtattcctttgcctccttatccctcaacctcggaaacagaagctttaaaaagggcgctatgagtctctcaagcttttttacaaggcctaaggagactgcaacgttcataatcccggaccatacccccacgaccccgaacatcaggatacagagttgtacagcttccttagaagaatccagaatcgtgtctgatacggcattcagattaccgtttatacttcctattaatatacctgctaagattaaaatactccatatataattgatcaaaggaaaactcctttttcgttcttagtgtatcctattcttttccccataagaatatgcttcaaagcccggatttgacaagctttgtgaggtatgatattgttaggtatagtagtttactaatttgcaaggagggaagcgaatatgaagagtacaggtattgtaagaaagcttgatgagctgggacgtattactttaccaattgagttaagacgtaatctggatgtgaatgagagggatccccttgagatcttcgttgacgaagatacgatcatattgaaaaagtacaatccagcagacatctttactggcgaaatggatgatctcgttgagtacaaaggcaagaaagtgtcaaaaagttctatcattgaattggcgaaacttgctggtttaaatgttgcagaataaagcagtgggatatagtgaaaggacatatgctggatgatatgtcctttttttgatgttattttatttcttataccggagaagctcctgataaatgtctctttttcctactccgcggtctttggccaccagtttcatagcctctttttgtgagaggcctttccctaaatagcgttccatatgctccatcaaatcgagttcctgaaactgctcctggctctcctttttcagttcctccaatgttcttccctgaatgatcagaacacactcaccctttgccggatgttcggtataataggagatgacctcttccatctcagaaacaaataccgtttcatgcttctttgtcagttccctgcagaccgtcattttcctattccccatcgtgctgtaaagttcctccaaagtctttaacagcctgtggggagcctcatacaaaataatcgtccgtgtttcatccttcagctgttctaagatcatggcgcgctcttttttatctggcggcagaaatgcttcaaaacagaatcttctggttggctgtcctgaaataatcagtccattgatcagggcacatgcacccggcagggacgttacctgaatgccgttttcatgacactgtctcaccagttcttctcccggatctgaaatgcccggagtgcccgcatccgtaatcagtgcaatgtttttaccatcctccagaagctttacaagataacgggctttttccacgcggttgtactcgtgatagctcgtcatctttgtcttaatatcaaagtgatttaaaagcttaatgctgtgccgtgtgtcttccgcagcgatcaaatctacggcctttaacgtttccagtgtccggaatgtaatgtcctccagattgccgatgggagttgcgcataaatataatttccctgccatttaaacctcctcaggtttccatccataaattttataaatttcttcggtatactgcccaggcttttcatagatgatcaaaggcggttcgaccttcatcctggacttccctccttttactgcttccagcaaaaaaatattggattctttttccctgtaaggatagacaaaccggattcttttgggctccaggccgtcattgatcaaacagttaaggatctcagaaagacggtagcttctgtgaaccaaaaacaggcttccgctgtgttttaaaaggactctggcagcaccggaaatatcccggaatctgcacaggatctcatgccttgcgatggcctttgcatcatttggattcttgaagccatgatcatccaccatataaggcggatttgaagtaatgacgtcaaagctgtcatgtgaaaaaatcgcagaagcctttgtaatatcgccttctacgatctctatcttttcttccagcccgtttaatgcagcacttcttgctgccatctcggccatctcactctggatttccagcccggtaaaatgtctcccgggtgtctttgcttccatgaggatcggaagaatccccgttcctgtaccaaggtccagcacatttccgtttttcttcacttttacaaaagaggacagcaaaaccgcgtccataccaaaacaaaagccgtcttttttctggatgatctgatatccctttatacccagatcatccaagcgctctccgtctccaggtttaattctcatgattcttttgactgccctttccccgtctttttctcccgtttttcggatgatagttcaaatcatccagcctgtactccacaatttccttatcaccgttgtcatcttctacgatcagcttcacattctgtctgagaatattgacccgctgcacttcgccggtccgtccgtccgctgttttcactgcgtctccgatgctcggcagtttcttgttcaggtattcgtatgtttcctgttcatttttcagacagcacatcaggcgtccgcagaccccggaaatcttggtaggatttagagacagactctgttcctttgccatcttgatggagaccgggatgaattccgacagataagaactgcagcacagtgcccgtccgcagattccaatcccgccgagcatctttgcctcatctctcacaccgatctggcgcagttcaattcttgttctgaagattgatgccaggtctttcaccaattcacggaaatccacacgcccgtctgcggtaaagtaaaacaggactttattgttgtcaaacgtatactcggtagctaccagtttcatctccagtttatgttcccggatcttctgtgaacagatggagaaagcttccttctctttcttgaaattttccagtgctgcatctttatcttccctggttgcgatcctcagaaccggttttaactcgtcagagacggcttccttgtccactttcttcttgtccgttacgaccctgccgtattccacaccgcgggcagtttccacaatcacatgatctccctgctttatatcaaacttctttggatcaaaaaaatatactttcccggcagtgcggaaccgcaccccaactacttctaccatatctttccattctccttcatcgtaagaagcaacatctccatcgtcacttcaaaattcacgttcgcattcaagcgtactctggccttctgaatctcgtccatgatatgggtaaggccctcaaatgtaatatagatttcctgctctttaagctggcggtacttgtccttgaaaatcagaagattcacagatcccgtcgtcttgaggatcagcatgtctctgtaccagtctgtcataatatcaagaaaatcataaatctgttctttatattttgtcaatgtctttaagtaagaaatcatctcatgaagctccatatgatgtatataaccaagcattcccagcgcctcgttcagcatctcgtggaactctttggtcgtagctacatggatggcctttccaaggttgcccagtgaaaacgatactgcaaattcgatcatatcctcatctgcctgtatgtgttccttcaggtaagccctgatctgatcttccgggacggttcccagagacatacatacacatctggataatatagtctccagcagacggtctttgttgtttgtcagcagcaggatcactgcatactccggcggctcttccaatgtctttaacagtgcgttctgagcccctacattcatacggtctgcatcatccacaatgtatattttgtaattgctgctgtatggcttaatgtctatggtctcattaatcccctgtctgatctcatccacgcggatctcgtatttttcatgtgttatatagatcagatccggatggtttcccgtatccgcctggcggcacggggtacattgaccgcagccttcgtgtgtctcacagagcagagcttttgcaaaggcttttgccaaagtcatctttcccgatccgtcttctccattcagtaaatatgcatgcgaaatctgtccggtctgaatggcttcttcaaaatgctgtatgatcttcttatgtccaaccacgttatcaaaactcttcatctcatcctcttccatccctatgaaatcaataccctgccggttcgtctttttatattacatccggtttgtctctcttgtcagggcatcatcaactgctacttttatctgacggtgaatttcctcaatggagtttctcccgtcgatcttaaccatcctgtttttatctctttcggctaacagcctgtatccttccaccactttcctgtgaaattccagcttttctgattccatacggtccagctctgcctgctgtttctttcttccaatgccggtctctgcatccacatcaagcaggatcgttatatccggcatagcatttcccactgcaaaccggtttacttcatataccagatcaacacccagtccccttgcaattccctgatatacggccgaagattctatgaagcggtcacagatgactacttttccctggtccagagcaggctgtatgacttcctccactaactgggccctggccgcagcgtataaaagaagttctgtcatatgtcccatgtttttataatccctgttgaggatcacttcacggatcgcttcgcttataaccgtacctcctggttccctgcatactattatatcataccccttctgcaataagtagactcttaataaatcaatctgtgtagatttcccggcaccgtccggcccttccatcgttataaatattcccatctcaaaccctttcatccactatgtatatccggccttccgacaggccaatcagattcatcttctgttcctggtactcattaattttctgcactatttctcctgaaatcctctctcccggcaccgccagcggtatgcccggaggatataaaaatataaaatccgcactgatccctccaagtgattcggcaggactcaccaactttctccctcttatctttgcctcgtaaggtgtcataacctgctcagtggcaggaataacagccagtcccggattttgaacatggtgcaggctttcatctgtttccagaaatgcctcacacaatttatccaatgcctcttttgtatcacaaatactcgtcatggcagtgacataggatatttcggacatctccaactctatcccatactcacccctcaaaatatgaaacagctctttgccggtaatctttgtatcgccggtcgaaacaacgatttttcccggatcatctgtctttaagagcttcaggtgtctcatagctttaagcctggcccggatatccattagattccgaacatagtcatcaaacaagtccgggctgtcagcacatttcctgacacagtaatcaatactggccatcaaaatataagacgggctgctgctctgaaatgtagataaagcctgctgaatctccctggtgcctatcctggaactgcatatgtgcagaagtccggtttgagtaagggaaggcagtgtcttgtgcagactctggatcactgcgtctgctccctgagataccgcactctcgggaaatccacggtgaaatacaaaatgtgctccgtgagcttcatccacgatcaggggaatcccctcttcatgaagaacctcggcaatctgcctgatatcagacacgatcccttcataagtgggagaaacgataacagcggctttaatgcctttttccctgttcaggatgtcctgcacctggcttctggtaatccccatacaaatattctgctctattttgggatataaataaaccggccttaatccaagcatggaaattgcatgatatacggacttgtggcagttcctgctgataagaatcttatctcccagccgacaggacgcagccacagaagctaaaatgcctccggtggtgctgttgatcagaaaataactttccttacttccatatatatgttggacatactccattgattctttaatcatcccctcgggatgatgcagatcgtcaaagccgctgatctctgtagtgtcaagcgcaaacagagatccctctctcataatgtcctgtttctgccttttgtgaccaggcatatggaacggatacatcccttctttatctaattgtcttaatttttcaaatataggatatttcataaattgttattaagcctcattttatcctattttatcatacacaccgtagatattccacgacattttaaagtgtgacaaggtattttgggaaaaagaaaaaagccctgataaaaatcagaacttttagatgcccagagccggaatcgaaccagcgacacgaggattttcagtcctctgctctaccgactgagctatctgggcttgggtattgattttactttagtccgcgtacaaaatctcaaaagctatacttttgagatcacggcgttaccgcctatatagaaacatttatcaacagctccgaatataaatatccggccctgttgataaatatttctatgcacgctctgaacgctaatggaagttgcgggggccggatttgaaccaacgaccttcgggttatgagcccgacgagctaccagactgctccaccccgcgctaaaatggtgggagaaggattcgaaccttcgaaggcgttgccaacagatttacagtctgccccctttggccactcgggaatcccaccatatacatatatattataccatttcagcataaaactcaaacataaaattacgtttataacataatttatgagagccgttgaccggacttgaaccggtaacctgctgattacaaatcagctgctctgccaattgagccacaacggctgacaaaaatgggaccaatagggctcgaacctatgaccctctgcttgtaaggcagatgctctcccagctgagctatgatcccaaatttatattataaatcctcctaaaaaggaaaaaacgacccggatgggaatcgaacccacgacctccgccgtgacagggcggcgctctaaccggctgagccaccgggccaaatctttacaaaataatctatgtaccttcaaaactacatacagaacctttcatcaaacatcttccttaccttctttggttaaagcctcgaccgattagtaacagtcagctccatacgttgccgtacttccacctctgccctatctacctcgtcgtcttcaaggggtcttactagattactctatgggaaatcttatctttaggggggcttcacgcttagatgccttcagcgtttatcccttccagacttggctactctgctatgcatttggtaatacaacagatccaccagtggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccacgttataccaccggatcactaagtcctactttcgtacctgctccacccgtcggtgtcacagtcaagccttcttctgcctttgcactctgcgaatggtttccgtccattctgagaagacctttgagcgcctccgataccctttcggaggcgaccgccccagtcaaactccccacctgacattgtcccccaaccagatcatggctgttggttagaaatccaatactgcaagggtggtatcccaacagtgactccaaaaggactggcgtccttctttctcagtctcccacctatcctgtacatgcagtaccgaatcccagtatcaagctggagtaaagctccatggggtctttccgtcctggcgcaggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcagaccttcgcgatcactcgctaagccctccccttaaccttccagcaccgggcaggcgtcagcccatatacttcaccttgcggttttgcatagacctgtgtttttgctaaacagttgcttgggccaattctctgcggccatatcgctatggcactccttctcccgaagttacggagtcattttgccgagttccttaacaacacttctcccgtcggccttaggattctctcctcatccacctgtgtcggtttacggtacgggcacataaaaaacaatagcggcttttcttgacagctgggggcctgggcttccctacttttgttcggtccgcgtaacgcctttgccttgcatgggggttttgcctcccatacggctccttcgcttgcgccagtttttccattcctggctcccatttcccttctgtgtccccacagttctgtttttatgtggtactggaatttcaaccagttatccatcgactacggctctcgccctcgccttaggtcccgacttacccagagcagatcagctttactctggaaaccttagatattcggccggaaggattctcaccttcctctcgctactcattccggcattctctcttctaagcagtccaccactccttacggtatggcttcatcccgcttacaatgctcctctaccaatgtattactacattccacagcttcggtgtcgtgttttagccccggacattttcggcgcaggatctctcgactagtgagctattacgcactctttcaatgtatggctgcttctaagccaacgtcctagttgtctttgaaatcccacatccttttccacttaacacgtactttgggaccttagctggtggtctgggctgtttccctttcgactgtccaacttatctcgtacagtctgactcccatcaatcatctggctggcattcggagtttgatatgttttggtaagctttgacgccccctagacaattcagtgctctacctccagcagactttgatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgccctcactgactagtttcgcgctcttaacgcttgctttcacttcggctccggaccttaagtccttaaccttgccagtacgggcaactcgccggaccgttctacaaaaagtacgcagttccccatctaaaggggttccacagcttgtaaacatagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcctgctagggtacttcagacttcggatacggggctttcaccctctctggccggccttcccaggccgctctcctgtcctacataatcccacatcgcagtccgaaccccaggatgcacgcatcctggtttgggctctttccatttcgctcgccgctactttggaaatcgaggtttctttctcttcctccgggtacttagatgtttcagttccccgggttccccacgcatggctatgaattcaccatacgctgacagaggttcactctgccgggtttccccattcagaaatctgtggatcaaaggatatttgctcctccccgcagcttatcgcagcttatcacgtctttcatcggctcttagtgccaaggcatccaccctacgctctttctactttaaccatagaacggacgatagttgttctatcatcctcattgtcatctagcgtgatgacaacgggtaattcgttttgtttgatgtcttgtcatttcttataaaaaataactttttgttctgtatgaagttttcaaggtacatccgcgcagcaaggattgcgtgcacaaaaagggaaggatatcacgtggagaattcattctcctaagcgcatatgcttttctttttgtataagcggctctgccgcgatcgaagaagcgaagcttctgagattcacgcgttaccaccaacaatctctgttacactttctattctggcttcttcagccattccatacaagaactttgttcttatatcgaatcgccaaagaatgttgaaataaaatccggcagccacctactttcccaggtcgtctccaaccaagtatcatcggccgtattggtcttaaccatcgtgttcgggatgggtacgggtgtgtccccaaaacgcatcgccaccggaaactttgagtacaaaacaggtttctctcctgcttgatacttttttgttatcattgataactaaacaataagacaacctctacttcttcttccttagaaaggaggtgatccagccgcaccttccgatacggctaccttgttacgacttcaccccagttatcggtcccaccttcggcagctccctccttgcggttgggtcactgacttcgggcgttactgactcccatggtgtgacgggcggtgtgtacaagacccgggaacgtattcaccgtgacattctgattcacgattactagcgattccagcttcatgtagtcgagttgcagactacaatccgaactgagacgttatttctgggatttgcttcgcctcacgacttcgcttccctttgtttacgccattgtagcacgtgtgtagccctggccataaggggcatgatgatttgacgtcgtccccaccttcctccaggttatccctggcagtctctctagagtgcccaccttaaatgctggctactaaagataggggttgcgctcgttgcgggacttaacccaacatctcacgacacgagctgacgacaaccatgcaccacctgtctccaatgtctcgaaagaaaaaaccggttaaggttcgctcattgggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgtttgctgcggcaccgaagcctctacggccccgacacctagtattcatcgtttacggcgtggactaccagggtatctaatcctgtttgctccccacgctttcgtgcatcagtgtcagtgacagtccagtaagccgccttcgccactggtgttcctcctaatatctacgcatttcaccgctacactaggaattccgcttacctctcctgcactccagcatgacagtttcaaaagcagtcccggggttaagccccgggctttcacttctgacttaccatgccacctacgcaccctttacacccagtaattccggataacgcttgccccctacgtattaccgcggctgctggcacgtagttagccggggcttcttagtcaggtaccgtctgttttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggaccatcctatactgccagggcttttcacactgaatcatgcgattctgtgcgcttatgcggtattagcagccgtttccagctgttatccccctgtatagggcaggttccccacgcgttactcacccgtccgccactcagtcatataggaaatccatccgaaaacttcaatcctaaatgcttcgttcgacttgcatgtgttaagcacgccgccagcgttcatcctgagccaggatcaaactctcatgttcaatcttggatctaaaaagcgctagcttttttatccttgttttactgtgtcctttatataaagaacgttcgtgtatctttttcaaaagatactgaaaatctcttagaattttcaaggttgtcttattgttcaattatcaaggttctgctgtcgttttttgtcctgctcttacgagcgacagctttattatcttatcattcttcattctgtctgtcaagcacttttttcatttttttgaagtttcatgaatgactgacatttcttgtgctgttcgatcaccgtcagcaacttttatatcatatcatggcatgtgttccaagtcaaggacttttttcaaaaaatttgaagagccaggaagtcagatgaagttttgaaaagctgctgttttgtcagcaacgttaataatcttatcatcgctcccggcaaatgtcaacaggtttttttacttttttctcacattattttgcgaaggaacactcaagtaaaaaatccaaaggaaaaagcccttggaaaatgccctgttatcaaggctttccaaaggcttcctttaaaatttaaaaaggcatcgcaccctttaacattgtaatcaccggattgttttctgccataaaccgaagcaaagaactggtctgcatgatttcattatattcctgcttgaaaccaatgtactgacaaaggtaaatggcaaacagtaaaaaggatatcacgataattcctttcacaaatcccagaacccctccgaagaaatgattgaaccatccaatcacagggaggtctccgaacttgctgatgacgccgaccagtattgaaaatacggccttcagtacaagcacgatcaaagcaaacgcaataaaatatgccagctgatctgtgagtatattctgctctgatttcataaacatctgtatcacatactgctttacggtgtccgccgccgaataggcaatggcaaaggtcaaaagccaggtcgccaaaaggagaagcgatttcaaaaatcctcgcttgaatcctctgatcgtatcaaatatcaaaatcagcagcaatacaattaaaataatctgtcccataatatcaccatctaacgtaatctaaccaactgtgttttatcttcaaatgtaatcaagtaccgttccgctttcccggtgggcgccatggcctgaatccttttcttaaaattctgctggtacatctcatggcctgcataatttatcatagagcaatgataatttcccacaaacagtactccgtccgggccaaggtacacatccgagaattctgtcttaatctctctctccataacctttctgccggaacggttataggcctgtaccagatactgctctttggaagacttctttttattctcaagaatcagggcaaaatgggaatcatccgcagcaatacttttgatcctggaatttattttaatctctttttgtttcgaaggtgtgtcttttgtgttaaaaataattgttttattatcaccaaacgcacaaaccgtattttttcccataaattgaatctttgggatcacagtatccttaaagtcaaatcccgccagcagccggtcttctttttcctgccctttttctccgaaatcataaaacgctacccggttcttcgtctgcagtccgtccactaccagataactgacagccagcatcgtgccgtcttcggacaggtcaatatccagcggatatccattttcatcgatcgtcgtcttgatcgttaccagcttcttttgagaagcatcgtaaagctctatataattttcattatctccctgcaaaactgcggcgatcactccctgttccgcaacttctacatcactgaccgcatatgaggcggaaaatctttttacttttccggtactgtcatatagaagaatctcattcccgttcttatatgcagctgcgatataatctccacagtatgtaacaatcggattcttgatggaataagccttctcccactctactttaccgtcaccgtcgataaacgaaatcccatcttcgttataacttatggagccatttttatatgcaaaggacttcgtcccggaatccacatgttctgccactgtccgttctgtcttgagcatgtggtaagtccgatatctgtatgccaggaagactgcaaacagtaccacacacaaaatccccccaagaatgatcctctgttttttgcggatctgttttttcaaaatagaattctgcattgcttccctgctgtttgtatagagggaaaaacctgattttatcctatggttcattgtaaaacccctgtatttttatttaacattatcaatatcacgctttattatacatgattttactttgttatactaggaataattagtttctgtccgggatagatacgctccttcggcccaatcttatttgcatccagtattttatacatatattttctggttccatacattctgcgggaaatggataccagactgtccccttttttgacgacataagtttggctgtgttccatggactgcgtagatttctgtgttgacgcagtggctgcggttgtgccggcttctgtttttttctcgtccgctgtcgtgcccgcctctgtcccgtccgctttttcggtgctggccggcagctgtttcgtggttgtgcctgaccccttgttttcttcctccattgaaacattgtccttcacgccttttcccatggtctccaccgccccatgaatcgcgtcgccaaaggaggaactgttatccaatctggaataatagaacattcctccggctaagatcaggacaaggagcattgccgcactggaggaaagccgcttcatcatgtcctttgtcttgctgcttttctgcttctcctggacgattgtccgaaactgccgcacaattttttcatctctcttggcttccagcatggattcataagatacagcttcttttaatttttgattccgctcaataaggtattcctgcatcatcggatttttttcatagtatatgtaataaccgctctgtctcaccagatcttgtccgcggtatacgtaaaatgcatcttccccctccaggtgatctgtcatatacagcactttcccgtcacccggaaaattttcaaaatgagtcttctttatcttatcattaagccttaccgagaatcccattctggaaagcgcccatccgatcacctccagatccggaaagaaacgttctttcttctgatagatttcccgccaaaccttatcgtcaaatacggtctcgtccaaatccagctctatattctgcccttccacagctcctctgataaatatcacagtctcattatcaatactctttttttctccaaataatatagcccctcttacaaaagtgtttttgtccgtcgtcaatgcttttaaaaatgtaactacaaaatcttcgatataaacttttgttgttcccacaggcccgccgatctgtctgatgttcttcggcaactgattttctgctctcacgaaaaagcctccctttcctctttaataccaaagactttaccacagtattttcaatttttttatcaaagggcgtcgactgaagaaaataattttgcccatgtgggaagtacgtattgggacggtatacttttttgttttatgtataaactatatggagcgtcttatacggcgaaaaatgatatttaagaaatgattggagaacgcaatgcgcatttcagaccgaatatcctattttaatcccaaagacagagaagcgggtgctttactgcaggcagatttgatccgccggattcaaatgcagaaaaaagacagccagcaggtagtcgtcctgtgtgtgggaacagaccgtgctaccggtgactgtcttgggcccttggtaggccatcagttaatgacatcttcttattataaagtcttcggaactttgtcacagccggtacatgccggaaatcttactcagactatggccgaaatttaccgctcgttcagggagccctttgttatcgccatcgatgcgtgtctgggttctgctgatcatgttggctatgtgaccgtgtcttccatgccgctgtttcccggacagggtgtagacaaagaactgccgcctgtaggagatatctcgattaccggcatcgtaaatttcacatcagagaccaactttaacaccatacagaccacaaggcttcacacggtcatggaactctcctcttatattgcatgcggagtagaggattctgtccggtattttgcgaaacatgctgcaacgacttaaagatgtcacatattcagtttcatatccccctgttttataatgcccatccggcgcatgccttctgatataaagtaagtcagcagtgcaggagcaatgatatgcattccaatgatcatgactgcggttgcggccggagaaaccccgccggccaccatagtcttatatcccataatctgccctactaatccggctgtccccatcccggaaccaatggcattgtttgtcatcttcaatattatagtagaaacaggtcccagcacagcactggtgaggatcggcggaatccagatcagcggttttctgacgatgtttggaacctgaagcatcgatgtaccgattccctgagcaattaagcctcccaccctgttctctctgaaactcgccactgcaaatcctatcatctgagcgctgcatccaactgcagcagctcccgcagcaattcctgagagatttaatatgactcccagcgcggctgaactaatcggcagagtcagtgccatccccatcagaactgatactacaatacccatcaaaaacggctgctgctccgtaccccaccggataaggtcgcccaatcgcgccatcagctgactgatccatggaccgagaaacagacctacggcacccccggataaaatggttgtaattggtgtaagcaggatatccagctgtgtccttccagagatcaggcgtcccagttcaattcctacataggcagccaaaaaagcgcccagaggttcccccggaccagagaggacgacagcccctttgacaatcagggttcccgccataatttttgatgcatatgctccaatcattcctgcacatgccgatgaaacggttaccagaaccgattcctgaaaacgtgaggcaactcccacgccaatcccggccccggtcagtactttggccgctgccgcaccaactgccaggacttgtccgatatttccgcctatcagcagtccaacttgttccagaatcgtcccgataatcagagtcgcaaacaacccctgcgccatcccggacaatccgtcaataaagaacctctttaaaaccttcattcgatcttctcctcaatattcttctttaacgtcattttaaatcattttctctctcactacaatattgactgttttatatttatcttctattatacttaatatatttcaaatagaaagcaggtaaaaccaatgttccgtatgtggggaaaactaatgaaaagcaaccggctgctgaaagacaccgtaatcagtgtggaagatgccggtctgaaccgtacccgaaaggtatataaggctcttgaagacatttgttatgagtttgatctgccgaaacctctctggctggaggcgaacaaaaaggaatttatgacccacgataaaacaagattttatcatgacagttttattgaagatattgactttgatttcttggaggtccaggttatcgaagaagaccaaagcctttagaatatttctacaggctttttttgtacaagctttacaataccggaaaacctatctataatgagagatatagagagaaaccataaacgggggaaaaagggagagaatgaaaatgaaacggcggaagaataaacctcctaccaagagcgctgttgattatattgaactgctctacaacaagtatgcgcctaagctgaaatatgtagcaaagcaatatattcataatgatacgttggctgaagatgtacttcaaaatgttttcgagaaagcgttgctgtactctgaaaagattttagaattgcccgatgaaaaggcctttacgtttttatatgtcatagttcgcaacacagcgtatgacatgatcaaggttgagagcagaaataatcacgaagaattgacttacgaggacggcgaagattcagaatacttgattgatcctaatgattattacatggaatatattgacttaaatgtaatggtagataagattggcaggctgccaacgaaccagcagacagttcttatcctgtactattattatggattcagctttctggaaatagcaacgctattacaaatttcggaactgactgcaaagaagcgctgcagtctagcccgcagttccttacgtgctctgtttgagaaggagggattgagttatgagtacaaacgataaaaaagacaaaaatgaagaattgtttgaccatatcatcgagtatggtgcaagcagatggaccgacgaaatctcccctgataatattcctgaagaggaactgtcggatcaattaaatcaaaaaattgacaccatattttcctcggccaggaaaagggcaaacagaaaacgcaggtttatcagtgcacggcggattgcggctgtgtttgtggtactgcttactatggcttctgttactttgatgagtgttgaggctttcagagagccagttatgaattttatatttaataaacgtagttcccagaatcggacaagaattcagattcaaacacatggagaaaacaaagattttaattttaattacttgccacctggatactctttctctgaaaaaaaggtaagtgagaataatacacatatattatataaatttaaagataaatcatcgaacataatttatttaaatattattttaaatacttctgcaaagaattatagtaatatgaataaaaatgattacagtataattaaaagaaataatattgaatactattacatagatgatacttttagtcagcttttatggtataaacacaagactatttataaactaaatggaactctttctaaagatgaattattaaaaatagcagaaggcgttgaatataattaatattttaaggaacctaaaaaatttgggttcctttttttgtacatttttttataaaatatacttcttccacttaactacacaagtaaacacactcagataattcatgatttcaccattatctaactacatcagttattcaagtagtaaggataatgggaggaattatgaaacaatatttaaaacatttaataatgtcacttgttttagtactatcaattctgttaatttcagttcctgcagaagctagctctacacccgaggtttcatacagtaatcaatcgataacttcatttatgttaaaacccaattttatgtctaatagttggacaggatttcgtgacgcctatatagatctgcaaattgacaaatcaggtattgctcatttttacactcttgtatgtgcaagtaattcgaaatactattgtaaaattacaatgaaacttcaacgttataaaaataaaacctggacaactttaacgagtggtacatgtactagtaagtcagataatatgtacagtagaagctactatgtgtctaaaggatataagtatcgagtttatagcaaggcctatatttataaatctaaaaatggaaaacttataaattcagacacatttacaaaaacaaaaaccagaaaataattaataaatattaaaatccttactgaatttaaaaaagtgctgttaaaaattatttgacagcactttttaaaaaatattcacctttttgctctaaaaacagtttctattatagaggggtattttttcaatcattattcctaagaacatattaactattataatattaaagaaaggaaaaccatccaaatcacaaaccattctaaaaaattggttaagcgggtgcggaaacctgctttaatggttgaatctacccctcttgttaaaagctaagattataagtatctgagcttcagtgagcagagagtaccatgaattcataataacattggtctttctgcattttttaacgaaacttgcgaatatgtttcactatttccatattatttcagttactattatagagagcattaacaacagattgtgattatttcgctggacctcattctctctctcataaaaaatggctggcgaagtttttacaatctgttgttaatgctcttttaccgtgataaaagcaaaaacaggacaaagtcaaagtgctttgtcctgtttctatttgatatatttagcaattttctcagcttcatatatactgatcattccttcaatattcatttcaaattgattcacatgtcccagtaccgataaagttctgtctcccttataaaagctgaattcacctccagcaactttaagtatttttacttttgttttttcctctccaaaaagaattttttcagaaccgtttgttgttccgctgtgatcgtaataagagtaatacaacacagcctctcccctgctgtaagatgctataatacctatgactttcttgtcaagaacattaacaaggatattttgcagtctccatccgcgaggcatatatcttggatacattacatcccgcttataattattctttacttcctcccaggtagatacccgaaaattagttcctgattctgccccattatcttttgttatgtttcgtgcaacaaacccttttatcgtctctatcagctgatcagcaggcgattcccctgaaggatcatttatttcaatctgaacttctgtcgtcttttcgttttttttattaatgtaacgaaaaatagactttcctgttatcgcataacatatcacctgcgctgaaagtataaatacaagaagaaataccgctgcctttgctgcaatcgagcagtacctcttccttcttcttatttttaataagcttcttctttctatatgtccgcagtagaatgcttccttatcaagcttaccttcatcttttaagggctccatacattctaatataagttctatatgcagtaacttctcttgatctgattgggatttaaaaaattctgtaatccattcaaaagcccatctcttgattataaaatctttcatcctttgtacctgttctatgttctgtgaattttctatttattgtaacagataattttatatatgtgaatcataaccaagaaccgacgatttttacggattatttctgggtcttattaatatctgtaatttttgaccttattttttcttttacatcctctgataatgtttcttcttctatatcctctggatggatttcctctacaaatttcccaactgcttcctctagtaactgttcaaattctttccttctcatttcggctcctttcacatgaattttaaggttacatatctatatcccaaaaaaacacgcgaaggtgtcgtttaaattgactttattcagccaaacataataagaataaacagctgtttccttgctttttttcgtattcttgcaagttttgattttaccgcctgatctgtgctgtccctgaatcccgcaagctcattgatcgtaaatcctttcatataaaaatcatagaaaagacgaaattcgtcttccgagagtacatttttaagatccacttccagcagtccgctgtaatcgtcctcaaacttttggtttaatgacattatattctcgtctgtcagtatctcgtctatcctatttttcttctcaaacacatgatatgttttgtattttgctgtctgtttcagccatccgacaggattttcatgttctgaaagactctctattttttcatatgccgtcagatatacttcctgaaggacatcataggcctcctcccagtcccaataaaaaaaccccttcataaatttgagcatctcttcataactttcgtcatataacaaattaaatgcattttctcttgatgtatcatccatatattaacccgcttctgattttttgttacagcataacagaaaattatctgaaacgcaaaaagacagcatatggcatggctctgaaagtcatgttatatactgtcttaatctactgatcagcgaacggcggatctcccgttcctgttacttatggacaatcatagcatttagaattaagtgtttactctgctccctcttccggctgagttgcgtctatatctccaagtctcatggcctcatactgttccaggatcatggtctggatcgtgtttctcgttgccgaattgatcggatgggcaatgtcacggtattccccatcggcagctttgcggcttggcattgcaatgaacaggcccttttctccttcgatgactttgatatcatgtactacaaattcattatcgatcgtaatagaaacgactgctttcattttcccttcttttgctacttgtctgatacgtacatctgtaatttgcatgttgtcttcctcctagttttcaaaactttagctaatgatctgttgtgcggccgtttttactctatcaccttcccttttcagtgccgcaaaatatccccactctcaacacgttctgcccatactatgactcccactgtaaacatctatactctaaaacaaagcacctgccgccttccaaaatccaaattggaagccgatcctgatgcttgtgcagggatcaacatcgtacatactatcttagataatgtttattatagcatctctttcgtgaaatgtgaacaaatattattatatattttcgctgatattattgtattttactatttagcggtacaaaatacgacgatatttccatcattctgtacaccttttttgccgaacccccctgtttctcatttccttccttgcaacttatttttttgtgcactataatagaaaaaacactttttttaaaatcagagaaaggttaggaattcctatgtatcaaatagatttcaagaaaccaattcatattcattttatggggatcggcggcatcagcatgagcggtcttgccgaaatccttctcaaagaaggatttactgtttccggttccgacatccgttcctccgatatcaccgaaaaattgagttctttaggcgccaaagtctttttagggcaagttgcggaaaatatcacagatgatattgacctggtggtatatactgcggccatccatccggaaaatgaagaatacaaagccgcactgcagaaaggcatccctcttatgaagcgtgcgactctgctcggacaaatgatgcacaattataaaaatgcagtggcagtatccggaacccacggcaaaacaaccacgacttctatgctctcacacatcctgctggccggagagacagatccaaccatcactgtgggggggattctggacattattgacggcaacatccgcgtcggccattccaatgtctttgtgacagaggcctgtgagtatacgaacagctttctcgaattttttccgaagatcagcattatcttaaatatagaagaagaccatatggactttttccatgatattaatgaaatccgtgattccttcaaaaagtttgctcataagctcccggaagacggcctgctcgtcctgaacggggagattgatgacatttcttatatcgtagaagggctcaaagccaagtatgtgacctacggcattgataacgatgaatttacctatacggctaaaaatatttcctatgactctatgggccatggacactttgacctgtacaaagaaggaacttttgtagattccctgtcattaaatgtgaacggcctgcataatattaataatgcgctgtctgccgcagccgttgctgatttcctcgggctctccatagatactgtaaaagccggtctcctgaccttctccggtgccaagcggagatttgaatataaagggacctgcgggggctttaccgtcattgatgactatgcccaccaccctacggagatcaaagcaacattaaatgcctgcaaaaattatcctcacaaagaattgtggtgcgtcttccagccgcatacctatacaaggacaaatgcctttttagatgagttcgccgaggctctcagccaatgcgatcatgtgatcattaccgatatctatgctgcccgggaaaaagacaccggcatggtccacgccagagacttagcagataaaatcgaaaaaaccggtactgacgttcgatatatcaaggattttgatgcgatagaagaatttattttaaaaaaatgcaaaaaaaatgatttgttgataactatgggggccggaaatgttgattctatcggcaatgagttagttaagaaatagttatccacgttatccacagggttatacacaattgtgtataactttccctgtggatttttctttattttttccacatcaagatttttaaagtgaggcttgtctttctgcggattccatttacttatccacgttatccacagtttccacaattattttgtggattactctgtgaaaagagctgctatttacaatttattcggtctgcgttatagttcttttagattaaagaaagagacgtattgactaatattagggagatggatttatgagcagtattaacgtaacgacaacatacccgacagggggaactttattaccgaatgccttcgtagactactacatgatcaaagccaacggagaatatgtgaaggtttatatttacctcctgcgcatggtttctaacggccagaagtttaatatatcttgtctggcagatttgctggaacttacggagcgtgatatctgccgcgccctgaagtactggaaaaaagaaaatctcctggacctggtcatggatggcggagagatccgttccatcaaactgctccccgtttccacagccctgacgattgacgcggacgatctcatggagccggaaaaagaaaaacctgcgaaagtaccggcagtggaacccgcggccgttgctccggctgcgaaagctaaggcagttccggccctgaggacgctgactccgtcacagctggcccagaaaaataaggacgataagttttcttatctgatctatatcgcagaaatgtacatagggcgtccgctcaccgccaatgatctgaatactctctcttacttctacgatgaccttgcgatgtcaccggagctgatcgaacacttagtagattactgtgtatccaacggcaagaaaaatttccgctatatgcagaccgtagcgattgcctggtatcaggagggcatccgcacagcagacgaggccaagcttcactgccagaactatcagaaagagtattatcagatcatgcatgccttcggactgaataaccagcccgcaccggcacagattgagtacatgaaacgctggctcaagaccgacggctttgacttgagtatcgtcattgaggcctgcaaccgcacgatccgctccatcggccagcctaaatttcagtatacggacagtattctgaaaaagtggaaggacaaccatgtggtttcactggatgatgtgaaaaaactggaaagccgcccgggtactgtatccaaagccgcagccccacagccgaacaaccagttccacaattttgaagaacgtgactatgactatgatgaactggaaaaacagctttttgaaaagcagatacaccctgtaaaggaggactgagatgtccctgaccaatgaacaatatcaggaaatcatgaggatgtacgaggcgaaccggctcagcggctacaatctctccagagaacgcaaacgtgaggtctatgcacagattcctcagatgagggatctggaccgggagatggctcacaacgctgttctcctgggaaaacagctgatcgcatccaaagatcataattcaatggatatctgcaggcaaaagaatcagaagctggctgaccaaaagcgccggcttcttttagatcatggatatcctgaggattatctggaccctgtttatacttgtcccgactgtaaagataccggatatatcggtaccgaaaagtgccattgtttccgtcaggctgtgattcgcctgatctattctgattccaatatgcagcaaattcttgaaaaagagaattttcatcgtttcaatgatcaatattattctgataaacttctggaggacggacgtccttctccgagacagaatattcatgccgtgctgaaaaaatgccgtgatttcatcggacattttccttccagggaaaacctgctgctgcacggttccaccggcaccgggaagacctttttaagccattgtatcgcgaaagaaatcatggataagggctatacctgtgtctatgtgaccgcatttcagttgtttgatattctgacttcccaggcatatcaaaagcgtaaggatcatctccctatgtcctaccagctgatctttcactgtgacctgctggttatagatgatctggggacagagcttaacaatgccttcataacttcccagctgtttcactgcctgaatgaacggcagctgagcggtaaatcaacacttatttcaacaaacttatctatgcgtaatttaaaagaccgctatacggaacggattttctccagaattattgagaactataccatctgccaaatatacggcgaggatatccgtttaaagaaatctttttcccgcaagccttgacggaatcgcttcgggagtgatataaaaagagtgaacaaactacaaaggagatttataatgagacgatctgaccgaaactttaaaacccttcccgacggcaatcttggcatcatcgctatggagagctgcaaaagccttggcaatctgattgacaagtatattacaggctggcgcggagatgaagccccccgctatcagaatatgcccggatatgatgagtattacaaggaaagctatctgctggatgccggctgtccccgcttcggctccggagaagcaaaaggaatcatccgtgagtctgtccgcggaaccgatttgtacattctcgttgatgtgctgaattacagcatcaagtattccctgtgcggtcatcagaactctatgtccccggatgatcattttcaggatttaaaaaggctcattgctgccagcggcagcaaagccaagagaatcagtgtcatcatgcctttcctgtatgaaagccgtcagcacaaaagaagcaccagagagtctctggactgtgctatgatgcttcaggagctgattcatttaggagtacagaatatcattacatttgatgcccatgaccctcgtgtacagaacgccattccaaacagcggctttgatacagtacagcccacttaccagtttgtaaagtctctggttgagcagtgtgacggagtcaattttgacagcgatcatctgatggtcatcagcccggatgagggtgctatgcagcgctccatctatatggccaatgtcctcggcgtcgatgtgggtatgttctataagcgcagagattattctactatcgtagacggccgcaatcctatcgtggcccatgaatttttgggagcttccctggaaggcaaggacgttctgatcctggacgatatgatatcttccggagagagtatgatcgatgtggccaaagaactgaaagccagaaaagcgcggcgtgtattttgtctttctaccttcggtctgtttacaaacggacttgatgtcttcgacaaggctgtggaagaaggtatcatagaaaaggttatcacaaccaatcttacttaccagacaccggaactgttggagcgtgattggtatgtatcttcagacgtgagcaaatatgtggctctgctgatcgatacgctgaaccacaacgggtctatcagcgaactcctggacccaaccgagcgcatcaaagaatatttggaaaagaatcatttataaacttatcagcagtatagcaaaaggcagcagactaattattttaagtctgctgcctttgtttatttattcatcatttccggcaccgcgccggtcatcaccggtctgctgctgtgtcgctgctgttgtggcctgggtcgttgcctgagtggtcgcctgggttgtggcctgggtagtcgcctgagtcgttgtctgggttgtgcctttcgtacttcccttttctgtcgtacctgctgttgtctggcctgtagccggcatgtctgtgccgcctccgccttcataggaattcagctttttgcctcctgaaaactctttgtggagttcattcataaaattgctccagatagtcttaggataaccggaaccgctcaggttggccattaccctgctgtcatcccttcctacccacactgcagttgtgtagtaaggggtatatccgcagaaccagccgtccttgttgtctgttgtagtacctgtttttcccacggtatctacattgggaacctttgccccccgtcctgtaccgttggtgataacactctttaaaacgctgctcatcatagaagccgtattggctgagtaaaccgttcttttcttggatggattggagaccacagtctcaccgtcagagtcctcaatcttcacaatacaggtcggatctctgaacacaccctgattggcaagtgccgcatatccgctggccatctcctcagccgtagttccataggtgaaaccgccgaggcaggttgtataatacttatagtcattttcatctagactcttaaagttcatcttttccagatacctgagagcggatttcggcccaatctcctcgtaaagcctcatcgtagccacgttgcttgatttctccaatgcacgcctcagtgttatacttcctgaataggaacctccggaattccggaccctgtgtttgtctttggggttcattggattgtcatttacaatagaacccggtccatatcccctctccatagcaggagcatagacaaggatcggcttaattgcacttcccggctgtctcggactctgataagcacgattcaggcctaatcctgcatttttctgatatctgcctcctacgatggctgctacctttcctgtctcattgtcaatacagacaccggcgccctggactttgtaaaccttgttcttatccttctccgtatatccgctcagagcattgtcgatactgctttgaagttccttctgagcattcaggtcaatggatgtatgaatctgatatcctgcactgtataaggttctcttacactcagcataagacttattatatttttcatcgtaatcctgtttgtcttcgtcagagtcaaacacataacggaactcaaatccctgcttttccatcagtgcctttgtagcactgtgaattacataagtttcaatataatttcttttctgctcagtctttttctttttcagtgtgatcttttctctcagagcttcatctctctgagatttggtgatcagattctgcttatacatatctttgaggatcttgtctcgccttgtcaatgtcttttctttatgatgatagggttcatacatgttcggcgcattcggaaccgcacacaaaaatgccgcttctgacatggtcaggtccttggcatccttatcaaaatagcctttgctggcagcctgaattccgtaatagccatttgcaaaataaacgttgttcaggtaaaactccatgatctggtccttggaatactccttctccagaccccatgccacaaacatttctttgaccttgcgctgccaggaaatctcccgagtcaggaatacagtccttgccagctgctgtgtgatcgtgcttcctccctgagtaacttctcccttatttgtaacaaaggatactgctgctctggcgatacccctgaagtctactccattatgtttgtaaaaattattgtcctccacggaaatcattgccgctaccgcataaaccggcagatctttatacttcagataatagacatccttctcacctttcagtttggtgatcaccttcccattcgtatcatagacgacactcgtctgggttgccttaaatgtctgctctgaagtgttggctaccagatccttagcctctgccctcagcttcatgactttcattccgatggtgaaccagccgataaccaccagaagaagaaaaacaatggagatctttaaaagaatctttcttttctttttcttctttttgggttttttctctttggaaatgactttttttgtctcttttgtttcttcagccatattctccacctttcattattctctggtttcctctaaggaaatccagtggattttctgattcttccggtccagctgatgaaacagctctttcttacatgtaaataagatcagctgcctgccggaatgcctgctcaaataatcaagcgctctccgggtcctttcatcatcaaagttgccgaaaatatcatccatcagaaccggaactggttccttcggatatagaatctctcccgcggcaagcctcacagccaggtaaatctgctctacggttcccgcgcttaaatactttagatcaataaacctgtttttatattttaccataaaagacagtgattcatcaatttttactttttcgtacactcctcccgtaagataactgacgatctcactgacctttttgttaaactgttctccgagattttcccggaattccccggcggcatctaaaacagcctgaatggccgcatctgcctgatttatattatattctgtacggtctgtctgttctttaagaatttggtagtctcttcttaattcttccttaaagtcctcccgttctgtcgtttccttcttttctgactgaaccgaaagaaccgataacaccagaaataccgcacagcctgcaaagaagcccggatgaacaaagccagccgctgcaaatacagctgcagctgccaaaaacaacgggatactccgcggctttcggccctgatcaccagactcgggagccttcaaataacgctccctcttctctgtcaaaagaattgattcctctctgctttttcgtctcagcagactcttcttttctttcaaggccttcagggccagatcaatttttatatctgccgtattactgcctgtcagattggatgtatagttggtaagttccatagagagatttcctgacggagggatgtccccttcctgaatacagaaagaatccttatatgcaccgaggctcagggtatacagctttgagagatcaccttcttcacctgattctttatcatacagatgaagagacttttctcccgcccggaaccttctctcaagcagccaggcatgtccgtccgctgtaatctccatgacgcctccgtaatttcctccataaaccggcgtatatatagtatatgcatcagatctcgccgcaatgcctctggatttttccaaaccaaacagcatatgaacgataaactctttgattgtagtcttcccgctctcgtttggtccatatacaatatttaatccaggcacaaaggataattcttttccgcagaatttcccgaaaccgtcgatataaatattccgaatataaaaagcagatctgctctcccgtttttctgaccggcgcttcttatataatcccctggatgcctgctcaaatgcttcccctgcaaagtgcgacgcttccggcatcccctcaaggcggcacagtacggcgccgataatattatctttgttggattccagcagcgattcttctgtacagctaccccttgttttatcaataatatccacgatcctgtattctgctccgagcagatcaaaatcaggacgaatttctgctctttttgagccctgaaggaacagcgtaaacatctggttttcccccagcagcttcatctcttcttccgcagcacagagaatttcctgttcatccatatcttctgtcaggtccacccgtacttccacataacttttttgattgatgggcaggaaacggacgaccttcttttcgtctgtgatttctcccaaaaagattccgcggcgccctgtctccgtcctgtttaacggttccaggctgccgccgtaggcgatcagatcctctgatatcatctcaggtctgtgaatatggcctaacgcggcatagtcaaatcctgaccatttcagcttgtgaaaatctattggactgtgtgtgccgtctcctccgtgccctaacagaatatgaatcccttcttctttcccgggccctgcctcatcatataaaggctctgtaatttccctgctgtgatagctgagaccgtagatataggtattctgtgcctcttcgtatactctcgtaagctctctttcagtgaacagatgcacatcagccgaaaaacgatatcgcagatatgccgattcttcgtcaataaaatcatgatttcccgcaatcataaaaactttggtacataccagctgggacaaaaaagaatccagcctgtttaaatccctcaaggatggttttttgtgaaagatatccccacacagaaacaggaagtctgcctgttcttcattggccagcgcaatgacttcactgagactctgctcaatatcctttttccgctcttccccccatcccctctctgtttccggacaggctccaagatggaggtctccaacgtgtataaacttcatgtctcaccttctctatttcgcatagctgtaaaatacactgcctgcctttttaaattctctctccatagaagaccgttccgcctgaacagattcttccttcagaggatcaaaatatctgatctttgtattgttatagctcatgaccagaataaatgtgccgttggctctttttgcaatgatcggccttcctttgctgatgcagtagaggacgtcttcaaatttacacccggtgtaatccgctgccattttatccattgaatcatacagcatgccgtaaacatcttttttactccgcttcagctgaccataggtgacatcttttccctcggaatctgtgatcattttcacacaggcaattccggtctcgtctttggactccgccttcaccattgggatatttgccacttttccatagcttttcatgacgcctttttcccacaggtacagctggcttgaattgaccaccacccctgcatttttctgggcttctttaattgcttttgccatatccgtataagtgcccttcagtgaacctccggcatatacataggcatttttataccgctgttcattaaccgcaaaggatacgccgcactctttctcagtctggctgagcgcagaagacagatacttcggaacggtctgtacatatacataatcagggaatgaaagatatacctgattcagacggtctcttgtgtatccgtattccagggaagctttatcctccgtcttatctttgtagcggatataatcctctttcatgcttttgtaccctgttcctgagcgtctggccggactgagtacgacaacagtaccgtctacccttgcgtccgtaacatagattccgctcttttcaaacttggcctgttcctgatttttgtcatcggcaattgctacttttttcattggaaactggatggaaccgtcttttcttgtcttcacatcccctgcatctgcgataccgtacacaaggtcgtctttcacaaaaccaactggtttgatccgttctcccttctcacagcgtatcttatgctctttgttattttccagatctataatccgtatagccgtttcgttttccgttatcgcaagcattccggttccggagactgcgaccatgccgctgctgatatttttcgcgatggtctttgactcccggctgtccagatcaacttgatagtaagccccgtccagctcaaagtagaactttccgctgtcactcaagtatgctcctttttcgatttcatcttttaaattttcatactgaatcttcaccggtataaaggctttctcttctgtttttccgctctccgcttcaaattcatagaccccgataccattcttcccttcgtgttctccacggttcatatatccatatacaatgaatttaatgttaccgcttttatccatctccatcacatggataccgtgctgcggataattatttcgggaatctctgtaatcttctcctacaaaagaaaacactcttgtcatggaagcatttttataatcgtaataccacaactcattttcctgaacaaatgccgctttccgcccgctgttcctgctgatcagttcttcgggattcatctgcgtaatacccatgagtattctgttgtttgcccgatccaatgcgtcatagcggaaaaatgcattctgtgtccgctcataattgagcagatacatccggtctttggaatatctgatgcggaagtattcttttacctgataatactgcttgatccctttactgttttccgcagacaaaataaacctgtactctaccgatgtcacattagagctggcctctttgatgaccggcgcgtacatgcgctcggtttttggtttcagtgatgcatagcagaccgcctcctgattagaagaaatatccacgaaagaaagatcatttgtgatagttccatcctttacttccaaatatttttttacatattctgagcttccctctgttaaagtcgcatcgtggaattcctctgcaaacttcagacactcggcaaaatgcagatcggtaccgtaaataatgcgggtataatatgtgatcgtttgcccgtcttcctctatcgacagagccaaaagatatgttttccccgactccaggcggctcttgacttttatgtccgctgccgctccgctttgtttctgctgaaaagccacgactcctttttccagggcagagcggttattctctttatatattttataatccagcgcttcaatagagctgtttccgtgtttcataaaaacctggaatctatcctccttcatgggcgtgatggaatctctcatcaaagatgcgtccacggactctgtatatccatggagttcattgatctcttctcctccggtgtttatggtcagcacaggcagggatgcctggctggtctcactgacaccctgattattttttcctatcaaaatataattccatattccaagagcaagaataaaaatcagtccaaagactgctgctggtatggctttttcccgcttcataagatcctcctaacattctctctgtcctatctgtatattttatccgttttcctggggaaacacaacaaatttaaggaaactttaagagcagcagactgcttgacggtgatagtaaaaaattacaaagaccaaattatgaattcagactcggcgctgataatctaaggctattatttttttcagaaaatgatataataactataaataaaagaggaggaaaattcatatgcttgatcccattgtttttgctgcatagcagggagctatttgcagccatgctgaataacagcatgatttataacgtttcaatctcgacaaatagcccttgctgttccgatttaatatttttattttaggagagcagtatgagctataagaaagcaaaacatatacttccccttgaacttcttaaagaaatccaaaaatatgtagaaggggagagcatttatataccaagaagatcggacagaaaaaagccccgtgggacttctgccgcatctctaaagtattttaaaaaacgcaatgcacaaatatttagtgagtatcttgcaggagaaagccaggatctattatccgaaaaatattttctgtctctgaaaagcattcaaagaatcatccggcaggagaaaatgatccataacatgtaaaggtgagccgatacggatataaaaaccgtattggctcatctttttttcataataaaggatgaggtttgtactgacggaaatgagtgatagaattttttcagaataactaattcaggaggtgacattgtgaagcgaattttagaaaatccgccttttttctttcctaatctaatttagaacaggaaggagattttatgaaaaataagtttctcagaacggttgtctgggaggtacagtacttaactccgcctccagcagtgcgatactgcaaaaaatgcggaagacaaaaagagtttgtcagttccggacagtttagggttaatgcacagagaaaatacctggacgtctggcttatttataaatgttccggctgtgaagccacatggaatctgactgtcttatccagaatccatcccaaagcagtgagcagagaacttctggataaattccacggcaatgatcaaatacttgcccataaatatgctatgaatacagatttgttgaaacgaaacggctgcaaaattggtccatatgattacaagataaccggatgtgctgcatttgacggacctgttaggctgcatatcagaagtaatgatgcatcagatgtaaaagtatcggcaatacttcgtgaaaaactgcagttatccagaaaagaatttgaagacatgctttcagacggcagaatacaaagcgagtcagaaaaggatttaacaaagtgcagactagggaaggagatccttttagttatctcataaaaatactctctggatctccaaaatacataatttgacattttagtgattatattgtaaaatactaggtgatattgaaaaaactttccatatatgataaactaaaggagataacaaaagatgaaaaagtctaacaatatatcacttaaaaatgactatgctttcacacagatcatgaagcagcctaagatactccggggatttttaagcagtatcctgcatattcctcctgaaaagatcgggaccattcatataaaagaccgccacctttccaaagatcttctggaaggaaagctttccatacttgatttgtataccgtagtggaagggaccggaaaaattaacatagagatgcaggtactgccctacacacactgggacagaagatcgctgtcctatttagcaaaaatttacactcaggatttaaaatcaggagaagcttatgccaactgtgttaagaccattcatatcagtattcttggtttcaatcagctggctgacaccaattatttttattcctcttttcatatgagtgaggacagcagacacagcctatacagcgatcagtgggaaattcatgtgattgagctgccaaaactgaactcttcaaaagtaaaagaagagcataaaaagttatatcaatgggcatgttttatttgcgcagagggagaggaggaacgtgccatgatagaaaaagatccttatattgaagaagccatcagagaacttgaattgctggaacgcgatcctgaacgtatggacgaatatttgttccgccaaaaaaatctttcagattatgtcacccagatggagtacagcagaaaagaaggagaatataccaaagtaattgatctggttcaaaaaaagatgcagcgaggaaaaactgaggcagagatagccgatgccttagaggaagatcctcagactatcgcctccatttgccgtatgatcagactctatccttcttcctcaaaggaagaaatttataaagcatggcagaacaaacccggcaccgactgacaaaagatgccgcaaaacaactgtactccagctgttttgcggcatctctgtcttcatacttatgttttttaatcagaaaacattctgcattttctcctgtaacggcatctgcggtgatagagttctcctcccagcagtgtgcagaccatctgataaagaaggcggtcttttttaatacagtcttctttttccatttccttgatcttgtcatagatatgatcggcaagtacaagaacccccgtgcggtccagatactcgtcaaacatcatacttcccttgtactccagctgatcgcaggcatcctcaatgtactcaagtactttacctgcaaccggtccatacatcttcgtaatgtactgataatcgtcctcatcctgctcatccatcatcaccatcggctttctggaaagagactccatatcaaatgtaggcagatcacccaaaccttcacgatccatcattttcgctgctccttttctctactgataatatactatgagaaaggagagaaaaaaggtacaaaatttttaagttatctgcgcatatcctcctgtttcaggctgtgaatctcttcattgatggccagcatcttactgtccagataactgatcatctctgcacattcccgaagttctgaccggatatattccggagcatgtccgtcatacttgtaataaattttatgttccagggacgcccaaaagtccatggcaaccgtgcggatctgtatctctacccttgttggaacgactgtatctgagagaaagatcggaactttcacaatcatgtgataactcctgtacccgctgggttttggattgaccatgtaatctttggtctttacaacttcaatatcatcctgattggagatcatatctacgatccggtaaatatccggggtaaaggagcagataactctgatccctgccacatcgtcaatatatctctcaatgttttctacggtaatgtcctgcccttttttcatgagctttcggacaatactctcttcacttttcatccgggattcgatatgttcgatcggattatatttgtgtacaaatttaaattcgtcatttaaaatttcaagctttgttccgatctctttcagcgctgactgatataacagctgcattttccggtattctaaaaaaatatcctttacatcaggtaattcaatctttgccatagaattcacacctctttctgaattgtatcgtatctggttctcctatgcctgtcagttctaaagaatattttatcacgagtacagaaagctttcaaacttacaactgtgaaatttttgtaaccagctcagcacatcagcattcctcctgtggcatcaaacgtaataccggtaaaataggaagccctctctgacacaaggaagacggccgcatttgccacttctctaggatctgcaattcttcctatgggtatctttttgttctgttcttcttcatcttttttatctttaaaagatttcatcagcatgtccgtcttcatgtatcccggagcaatggcatttacagtaattccgtattctgcagtttccctggcaagagatttcgtaagcccgatcaagccggctttcgatgatgcataatgagaatgatttcttttcgatcccatgatgcccgctttggaaaccacatttaaaatacttcccttttttcctgactccgtgagatggcagatcagcttttgagaaagcagaaacggcactgtcagattcatctccagaactctgcgaaaatcttcttccggcatttttgcagccatggaagttgtccaggaggccgcattgttcacgaggatatctgcgcccccaaactgttcacaggcagccaaaaacagtcctttcctgtcggactcctccatcatatctccctgaaatccaaagacctttccgggacactcctggttcatttggcggatcagtgcctccgcctcgtcctttcctgaccggtaattcatgaccacattggcgccttcctcagccagcacccggcagactgcccgtccaaagccttttgctccccctgtaacgaccgccgtctttcccgataaccctaactccatgtgtacctccttataactgccgatatctccggaacgccttcatgccgtcccggagatatagaatctgaacttaataagttatttaccgctatttccgtcgcgcttttgaaatgcgctcctacaatagcggtaaataactttcgaaaagaggcactttttttgacagtgccccttctccaacagacattacgtccattttccacatgattggagtgaggcattctaagagccgaacggaaatcatgtggaaaatgtcatacttattcatttactctgaactttttccaaggtatatcgagcattgatccatgctgtaaaacatcatcaatatgtaaaatcagaggaaaatcttctttttttatctgatttttctcagaaagaattctaacagctttcgccgcccgccgggcgatgaccactgattctaaagtcacacctttgagttcttccatagcctgttcatatggcattccagctccaagtcttttgccgatttcctttgaacggccgcccatgacggtcacatacaggtcgccgattccgtgaatggagttttcaacatttcctcccatgtactggacaaatttcatgatctcataagagctctgtccaaacagtgcagactgcgtgttgcacatatatttctgctgcttttcttccagaccgatgccaaggctgactccaagggcatatgcatttttaagggcaaccgcaatctccagcccggccacatcctgtgtcagatcaatgtgataatacggcctctctaaaagctttttaaagaactcaaggacttccatgttctttccgcagaatgcgactctcgtatcatcatgatctgccagctcatagcatctgcagggccctccgatggcacaaaattcgtggctcttacccttctctacatttgatgcaaacagttcgggaaacgtctttaccatcccgtcgtcatatacttcaacacccttagtcactgcgatcaccggtattttatccggtatctttgccagggcattttcaataaaccaatctaccccaaagctgctgactcccagaatcactgcatcacatccgtcaagcgcggcatccagctcttcgatctgaaatgcctttacgccctcgggcagtgttcttttcagtgagggatggtaacggtttgcctttaccgaatcaataatctccctgtccagcggtgtccccgtaagacgcatctcatttccgttttccacagcaggaaaggaaaggcttgatgccatcactcctgctccaatcaccgtaatcgtactcataagaccctccatttcaaacaacatacatacaataactattgtaacctatgaagcaaagcgcgccaagcccgaaggaagtttattttaagggataattgcgtatttgatgccttcctgcctgccgatgctctccagtgcatcaatggctttttctaaaggataatgccctgtgatgaacagactgccgtcgatctgcccgttggacagcagtttcagcgccagctgtacatgatacggtgtatgatggtaaacggccttcagtgtgatctcctcatagtggaacttctgacagtccagggtgatacttgtgcctgcctttgtgcccccgaatgcaagaaccgttcctccgggtctgaccatatttactgcattttcccagacttccgggaatccggttgcttccacgaccacatcggctccttttccgccgcacaaatctctcacttgatttatatgttcttccccagaggcattgacagttttccataccccgaatttctcagactgctccaggcggtaatctgacaaatctacggctataactctgcatcctttcagacttaacagcttcataaacataagtccgatgggtcctgctccgatgactgcgacggtgtctcccaccttggccggtatccggtcgcttccgtggaccgcgcatgccaggggctccagcagagccgcctgttcaaacggcagatgatcagggacacggtagaaattgtatttcaggatgtgcgccggtacagctacatactcagagtaagcgccgttcaggtactgcagattttcacaaaggctgtatctcttgtttttacaatgctcacactcaaaacaaggggcggtattagctcccacgatccggtctcctaccttgaattttgtaacgtcctttcctgcctccacaaccactccggaaaactcatggccgaatgtggaaggtacagaagtgataatcgtcggatgtcctctcctgtatgttttcaggtctgtgccgcaggtcagcgccgcttttacctgaaccaatacctcatcatctttaatctgaggaatatccgtctcctcaaaccttacatctcccggtgcataaaacatctgtgctttcattttcccctgcatgttaccatcctcctaattcttatttctgtccatagttttgatctgtgtcttctttcagaaatttacacatctgatcttccagcgtattgacatttcccatctgataagacagaaatgccaccttcgcgctctcttccagtacaatcgcgtcgttatatgccttgtcgattgtctcgtcaatacagattgctccgtgatttcccatcagcactgctttgtcgtctccgattgcctctgaggtcacttctgccagctcatcgcttccaggcggtacaaaagcggcacagcggatatttccgcctaccagacctgccgcctccgaggtgatgcaaggcattcctccgtccacacaggcccatgccgtacagtaggtagagtgggtgtggaccacaccgaacacatccggccgtctgcggtacatggcagtgtgaagcggcatttcgatggatggacggcgttccccttcgataatctggttatcaacacttacaaccactatgtcagaaggatgaagggtctcatagggcattccactgggggtgatgcacacataccctgtctccggatccctcaggctgaaatttccaaacgtaagaggaatcagcttttccttctgtatttttaacgcgatctcgataaccttggttctttcttgttctaataacatatagcctccttatgtgaaaagattaaaaaatcatctggaaaaattctgcgattttataaataatgtacggtactaaatgggctcctgtatccagggaagaaatcgcctttgcacctgccgggaacgtaaagtctgtggactgtgcgatcaatgtggcagttcctgctaagttggtagcaatgtataagattgcaatcatcatcaatgttcctgtgattagtgaacggaacaggtttcctttggatgcaacgaccggccatatcataaagaacggcagtgtcgcaaggtctaccagcggcagcaccctgtttcccggaaggatgactgccagcaaaagagtgaccggaatcatgatcagtgcggctgagattaccataggagatcctgttgcaatggctgcatccattccgatgttgacttcctttcccggaaacttttttgccagaaatttcttagcgtcttcgcttaaaggcataagcccttccatgagaatcctcaccattctcggcagaatgaacataaccgcagccatattgactccaagggttataatcttatttggctcgtatcctgccagagctccgagacctgccccaagaatcaggcctaaaaccatcggctctccgataattccaaatcttttctggatcgtctctccatcaaagtggatcttattgatccccggtattttgtcataaactttatccattaagatacagataggcgcccagctcacggtctctgtatgtggcagggaaactcccggaagaccgaaatattcctgcacccttggtgctgagtaatctgccagtttcataatgatgataaaggtgatgcctgatgctataactcccgcgatcatgcttcctgtcagaaactgtaccagtgccccggttaaaatgaagtgccagtagttccaaatatcaatgttcagtgtctttgttgtgttcgtagcaagcataataatatttaagacaaaacagataaggaacacaaacggtacaatctgtgtgccgaatgcaatggacgcgctgaccggccatcctacgtcgataaccgataaattcatgccgaaccgctgtgtcattgcctgcgcagcgggacttacaaagtcccccatcagtccaatgacgaggttaattccaataaatccgatgcctatggtcatgccggaccggaatgccttggaaaatttctgtcccaggatcagtccgagaatggttatgatcagcggcataaccacagatgagcctaaatctaagatgtactgtaaaacactcatagttttcctccctttctttttcctttactccaatgatttcaaatagtctgcgatttcatcagctttctcttccgctccgaacccggtgataaattccagcgtccggtaggttttatactcttttaactcgtttaccggaatttccgcggtgtggatgatcacatccggattaaaaatctctgctctcccgacgacttcaagtgctttgcattctgatatctccactgagggtattcccctctctgccagcagccgtttgcacgtctcagatgccaccgttgatgttgcgattcccgtcccgcatgctgataaaattctgtaagtcctcataatgaatcctccttatttttgatgatttgaataatttcctccggattcccggcgtttacaagcattttcaaaacctctgcatcctgaattaaaagaatggctctctgaagcacttccaaatgctgttttcctgcgattgccagcatcatgacaaacttgaccgggactttcacattttcttttggattggttcccatctgaaaaaaagataccggctctttcagcactccaatggcgattccggttgtttctacataacacggatctgtgtgcggtattgccacaccgatatctcctgctaagattcccgtgggataaaccttttccctttcacttaatgcactcacatagctttctttacagcaaccttctgaaactaacacacctcctaactgttcaaatatctcctgttcattttctgccatcaaatctgtctgtaccaatgtgtcttttaagttttcccagatcatgatttcctccgatctcaagtgtattggtctgtatttttgttaagttcattataggcctcagaagacaccctataaaggacaagagaagtcgttgaaacgagcactaaattgtactaatcgtaatacataaacctggcataagcttgttgactggcaaaaaaagaacagaaccataaaaaggttctgctccttatcttatccgcagtattcattttccagcctccggattgtctcaagcagctcttccggagactgctgggcttcaattcggctttttgcctcctcctgtgaaaacagacgcaccagattatagattgcacagttaatgctgttagagtttaagatgctcaggcctataatataactgaccggatcattttcactgttcccgaatactaccggttttttcaggctcaccagactggccgcctctctgacggcccctttttcctgttcagcgtgaggggctgcgataccggaataaatcaccacataggaaccgttgaccttaatattttcaaccatagcttctatatactcataggtgactgccccggattcatagagaagcctgcctgctgccctgactccctcctcccagctttgggcttcctgcttcagcgcaatcctgtctgccgagagcatagctccaagggaattcctctcggcctttttttgttttttgagaaattttcctgtctctgccgtctggcctccggaccagttttctcttaacttagtcgcctttctccggattctgtaaatgtcctcctgttccagcaggggactgaccatgagaatattttttatctctccatcgggaaatgccactgtggaaatcaccagctgatcgtttatattgcccatatctttcagttcgtgtgaggatctcacatccgtgatttcaagtacatcctccagctgttttagttttgccagcataagctggacggttccccttcccatggcgcatacgagaactgctggtactttccgttccctcatccgctccagtttgtcccgctccagcatagaggcaaaatacatgacaagaaaggaaacttcgtctctgggaactttcaccccaagataatcctccaatggtttcaggcattcttccaccgtacagaacacttcgggatatcccttttcaatctctccccgaaacggattttcaagaacctcccctgaagacatccgatagacagaagatttcatgtgatccaccagcagatcgtaaagtgcaaaatccagataaaaattaatccgaaacctgctgatgatgcggtaaatcacctccccgatcaaaacagggatcaccagctggtccacattattcgttccgctcttcagatagctttttcttctgaggcagaatacaaaattttctgcttctgctgccggtatatccagtgaaaattcttctgccagacggtccagtacagccctgctcagcggatattttgagctcagggatgcattttcccagtccggctgccgttcctgttctaatgtttttcctttttttaccctttcagccagaatcagcagttcatagactgccactgaaaaagagaagtcggaaagaaagcagtcatgcctcaattcttcttcccttaaaaccttctgtatcgtttcataccgtccctgatattgaatttcttttaggagaagatgtccgaacacgtggaacgcacccattgcgccatatttttcttcatccagattcagctcaaggagcttcagcataccggaacgtatatctccctctgaagcttccactatatatcctttttgtacctgagagacaagcttcatattatgtttcaaaaaccagtctttcaggtcattcagatcactgatcactgtgtttctgctcgtactgatatactctgaaatccaggctgcagtcacatacttctcttgattcaaaagaagcatcgcaaggattgtctttcgttcatttttggacaggtgatatgtataaaaatcattgttcataataaacgtttgaatctgttccaaaagcccttcttccctgacctcaaaccttaaaattccctctccgtttatactgaccgaaggcagtccgctttcatttaattcgtcattcagctctctgatctttttgcgcacaatccgctcagaaatctgatatttttcagaaatttccgccagctgcagtctgccccctgccaaaagttgatttaatatttgattgcttcttttatccaaatggattccctcttttcaatctaaatatataataagccgctatcttatcatatatattataggaaatcgaagtctatgcatatagcacaaatactggcagatttgtctgctgccgattgttctatgcataaacgcatctgtgtacatcccgcggagcgttttttattgcttaggaaagactttcacgcattagcgtgacaaggtctttcctaagcaataaaaaaccaattctaaagctgtgccttaaaatcggtttctaaattcaaatattctattttaaaatccgtgcggcctgcgttgaactctctccacagacgttacctccacagttaactcagcccaggcacccttacggcacatgaaaggttctacttagtgctgcttcgttcccgacctgacacggttcatagattctcattgcgtaagacccaaacatcaacgccacttatgaagggcagctccacagggaaaagcccgaaacaggccatcacctctgctttagcggattgcagatacagggcaccgctgcctccccggctgcacggaagctttttgacgtattaagattatattatgtgtgcagatttgattatactaaatattgttcacattcgtcaacttttattttattttctattttattttttacctttcaatactataattgatagaataaaggaaggtgagcctatgaattatccaatgcatgacggcactgcaaagctgcttacaacggaagaatattttcaaaattatccggacctgtgctcttatcagccatttcttgacaccgtcaggaatcatggcatcaacagctgtaaggccgatgttttttcagattttatttcaggaacgctcttaatccctgaaaaaaagaatccgtcagagaaggaattctgcctgtcttattatctttccaaagaccttttggtactaattgaagataaagaacatataaatgatttggagctgatcataaatgagagacacataaccgacgcatcatcactcccccagtttcttgtcctgctcgtggaagctctcatcaaagatgatatgctcctgctccagaattatgaaacctgtctcgccgagattgaggatgaaattctcacaggaaaagatattaaaataaatcaccgcatgattggtgtgcgcagaaagcttctccgcatgaatgcctattaccagcagctcagtgattttggcagtgaactggaagaaaactcatccggtttcttttcccagacagacgtgcggcatttttccgtgctcaccaaccgtgcggaacgtcttctcaattacactcagtttctccgggaatatgctctgcagatccgtgaaatgtatcagtctcaagtggacattaagcagaatgaaactatgaaaatactgaccgtagttaccacgatcttttttcctctttccctgattaccggatggtacggaatgaatttcagaaatatgccggagcttcattacccgtacagctattttatcctgatcggcatctgtgttttgatcttcacggcagaactatggttctttaaaaagaaaaaatggatttaaaatacctatgagtttttctccattatctccagtcggctctggaaaggcctccttccgacaatagagaaaaactatcacaggtagcaccttttgtctctaaacagcctgctccagcagatattacgtccattttgaccagtttggaggccttgcattcgaagagatgttagtttttcttctttcagcaaaggctcggaggcggtgtgcagagcacagtgaggctgtctgagcgtcagcgagttccgaacgggccgccggagagactttgctgaaggttagaaaatcttacatctctgagacagcaagccggaaaactggtcaaaatgtcaacccttttttctcagctgccggaaaaaatcgctcatcatatggctgcattcttctctgaggactcccgattcaatctctgcctgatggttgaattcttccctctgaaggatattgagaatggagcctgcacatcccgctttagggttcatcgccccgataacaaccttgggtattctcgcctggactatagcccccgcacacatctggcacggctccagagtgatatacatcgtacattcttcaagccgccagtcccctgtctttttactggctttctcaatcgccagtaattccgcatgggccagtgttgtctttctcttatttctttgattgtaagcccttgctatgatttttccgtccaatactatgacacagccgatgggcacgtcccctatagctgccgctttctttgcctgttttatggcttctttcataaatttttcattttcattcattctgtcttcctccggtcatattttttagtccctcctcatagaataaatcaaaaagagagtatcacattggctgaatatcaacgaatcgtttcatatctatacgaatacagcaatggcatgaaaggcgaaaatgcaggattcgccaaaattgagaagcgtcaaaaacagcttcgcttatacttccatgtcaaaacaaatgacgaggccttaacgtacaaaatctatttttaccggttccgccacggaaccatggaaggcattttattagattccttccagcgcaatgacactatcattgagtttaagaatacttaccctctggttgtagatctggaccaggtagacggatttttgatctatcactccaacagccatttctttggatcagagtggaatgacaaaccgatcacgatacgaaatttcctgccgacagaagacatggccaaaaatcccgaggctgaccggacagaagaagtcaggaaatctgatgctgttcagagagaagtgaccagggagtctcaagaaactgaccggacagaagtccctgttcctgaaacccaggaaccgccggaacctgctcagggagaaagcctttccggctccgcaccggcggatacagaaccgtcagaacctgcccaggaagatagtatgcctgagtcccgccctgtacagaatccttctccatcagacgaagaagtaccagaggaagatgaagaagaaccgccgtccggcgctcctgatcctcctcctataaaggatccttttgacgaacttccgcaggaaattccgattcctgccgggacccctgacacaaaatccacggtgccggaaccggcgcccgaaccggcaggtctgcctccccgtgtctatgtagaaccggaaattccggagtctgaacctatgagcgcagaatcactgaccgaagaggatacctccgaagaagaacctccagaagaaaaagctgccggacagcatgaagaacgtattgctgatcctgattcaaagctggcagaatatattgaagccctccaattggaaaagaaagccaaagaacagggagtgccgaacacacccagtctctttgactggaaggagtatcccaccttgcccttacctccttcttatatgctggatcctagcatcaaaatcaaagtagaggatcttcaaaatattcctcatgtgccggaaaacatgaaaaccaacgggtttctgctgctgaactacggaaattacggacacctgatgttatgtcagcacagacagacaaacagaatctatctgggagttccgggtgtttttgacaatgaaaaaaatttcattgcaaaacttttcggattcagggatttcttaaccgtgccggaatcctgtcaaaagacaggaaacttcggctactggattctgtctctctagccctccagcaggtcactgagccttgcaaactgttcaaggctcagtgcctcaccacgaatcttcggcgatagtcccattttatccaaagcgtctactacctgttctttagaaaaatggagtgtactgctattattaatcccattctgaagtgtttttcttctctggttaaaagaggccctgataatggaaaacatcagctgttcattttttacctttactggcatatccttatatcttgtcagacgaataacagctgatcccactttcgggcggggcataaaacagtttggcggcacattggccacaatatacggttcggcgtaaaactggacagccagtgacagtgcaccgtaatcttttgtacccggtcctgcctgcatcctctgtgccacttctttctgtaccataaccgtaaggctgttcatagggacattcttttcaaacagtcccatgataattggcgttgtaatataatagggcagatttgccacgactttgatcggtctcccctgatttttcttttctgcaatctttcctatatctaccttcagaatatcttcattcagcacttccacattgtcatatccggccagagtttctttaaggatcggtatcagattgtgatcgatctccacagccatgacttccctggcatgttctgaaagatactgggtcatcgtgccgatacccggtccgatctccagcacaaaatcgtcctctgttatatttgctgcgtctataatcttctcaagcacatgactgtcaatcaggaaattctgtccgaacttcttctgaaaatcaaagttatacttttgaatgatttctattgtttttttagggctgcttaacttctccatctaaacctctttcatccggtacatgttcctggcattttgttctgtgacctcaataatttcctttgtgctgatccctttgagtgcggcaatctgttctgccacatacggcagatttaaagaagaatttctctttccccggtttggttccggagaaagataagggctgtccgtctccagcaaaattctgtccagcggtgcataggagacaacctcttttaatgtcctgctgtttttaaatgtgacaactcctccgattccaagataaaatcccatatctaaaaacttcctcgccatttcttttgggtaagaaaagcagtgaaccactcccccaatctcctcggcgcgggctgcccgcatcatatcctctgtatctttcgcggcatcccggctgtggatcaccatcggaagctttgtctccctggcgagctccatctgtgcttcaaaccattttttctgtataggacgttcgggttcatcccagtaataatccagtccaatctctccaatagccagaatcttgggatttgatgcatattttttaagctcagccagatcctttgttttcatttcaccggtatctgacggatgaacccccaccgcgccataaagaaacggatacttatctgcagcttttaccgtccaccgtgacgtttccatattggaaccaatgtttacaatggtcccgatcccattcttctccatggaatccagcagttcttcccggtctttgtcaaactgctcatcgtcataatgagcatgggtttcaaaaatcatgttccttcctccaaaaattgttttcactctgatacaatttctcattcatatggtataataagaataattcttatttcattgcaaggctgtatctattacacaagacaatattttttattataacacgaatcggaggttttttatgagtatttttaaatgcagtatctgcggctacgtctacgacgaggaaagtgaatccgtccccttttcccagctggaagctgactatacatgtccggtctgcaaggcatcaaaagataaatttgaacccgcagaaggcaaaagaactccttcgcccataaaagataaccccctggcttaccccgatgcttttgcaaaatctgattcaaaagaatttccgcagatggatgccatacatcagatggctcttacgggttcgtcagtcgttgatgccatgggcaccttaaagcccatgatatcctgggatgatattttaatcatgggcgctcagctgaacccggcaccactaaatgcgggcgatcctgtggacaccaaaacagtgatcggtaaaaaagccaaaaagccaatggaaatatatcaccccatctatgtatcccatatgtctttcggtgccttatccaaagagttaaaaaccgcacttgcaaaaggcagcgccatgtccaagaccgccatgtgcagcggcgaaggaggaatccttcccgaagaacggcaggcagcttacaagtacatatttgaatatgttccgaacctgtacagtgtcacagaagaaaatctccgcagcgcagatgccatagaaattaaaatcggacagggaaccaagcccggcatgggcggacacctgcccggagacaaagttaccccggagattgcaaagatcagaaataagcctttaggtgaggatgtcatcagcccctccaagtttccgaatcttaattccaaagaggatttaaagacaatggtagactggctgaaagatacctccggcggaagaccagtaggcgtaaagatcgcagccggacatatcgaacaggatcttgaatggattgcatatgccgatgccgactttgtcaccatagacgggcggggcggggccacaggtgccagtccacggacattaaaggacaacacttccatccctacgatctttgcactgtccagagccagaaaatatctggaccggcatcatctttccatggatctggtcatcaccggaggactcaggcttccgggggattttgcgaaagcactggccatgggtgcagatgccgtggcgatcgcttcggctgctcttgtagctgctgcctgccagcagtatcgtatctgcaacacaggacagtgtccggtcggcgttgccacccaggatgaagaattgagaaaacggcttcatatcgatcattcggccaaacggctctgcaactacctgaatgtgtgcaggtctgagctggaaatgttcggacgcattaccggccacgcaaatatccatgatcttagtgtttcagatctcaggacaaccaacagggaaatatcagagtatacggacattgaacatgtgtgacattttctacatgatttctgttcggctcttagaatgcctcactccaatcatgcagaaaatggatatactatctgccggaaaaaactcagcaattttttaagtcttttaagggacaaaaacgggactgccgccagctaaatattttttttagctggtgtgaccgtcccattttatttaaaaggattcttatttagaattgtatgtccacctgacacatcttcattgcactcagggcattgtcatggctttcttttgtcactcctgcgcaaaggtccgcgtggacgatcagttttgcttcaggaagggccgcctttaccataagtgcattggatatcacgcagatatccgtgcacaggcctatgaattcaatctcggcgtccttaccctcatatttctgcttcagcagttcgcacagttcaatggagccaaatgtatctttccggcagaagtccatcacttccgcttctgtctcagagatggcatccatgatatcaggatgcagtgcccatccctcttcacccaggatacagtggggaacaggcagatttttaccttcctgtgtactgagataatctttagagtgagtatctaatgttccgtagatactgcctttaaactctcttatcttctctgccgctgcctcaacaatctcccttgcttctttagtccccagggcaccgtctatgaagtcattctgcatgtcgacaaccactaaaatatgttccatacagccccctatccgatccttgcagccacaagctgattgacaagtttgccgtcggcttttcctttcacccttggcattaggcttttcatgatcttacctttgtcttttgctgttggagtttcaatgccaagttccgcgagcaccgcatcaatctctgaattaatctgctcctcactcatttcctcaggagcgaattctttgatgaccgccaggcgtatattacattcctcaatgatatctgtgcgctctgccggacaggattccagggtttcttttgtctgtttcatctcttttgcaataattgtattttcttcggcctccgtgaggtcttctcttttatcgatctgtgcattttttaatgcgcttaacagcatagacaaagcttcttttcttgctttatccttatttttcatggctgctaccatttcttttctgatttcttcaatcttgctcataatgtcctcctgattttttgtttttattctatcatataatccaggagaaatcacttccttctgctgtttcttcctctgtacagataagccagcagtctccgtaccttcgcatttccttgtatggtttttcgatccgcggaaattctttgcttaaaaatgcgtgaacataaagcggttccttttctttcttttcaacaaccgtatctgccgtgatataaacggttcccgtgtccagtttattgcccttacgccccatcactttcatctgttcatatacatcgattccctctgtcataaacaaaaacagtttgatcggatggacccagatacaggtgtcggattccacgaccatgtcacagggaatattccttccctgtatataatccctcagtctgtgcagatctttgatctcttctttagtttctcctttaatgattcccattcctccgagctccgtcatgtccgcaatagttttctcttccatgatcatcacagattttccctgttctttttggaaatgagcctccactgcgttctgaagggatgcctccagatataatatatcaacttgcttatctgttttcaaaatcggataatatggaaactctattttttcctgccataaggaatgcatcaaaccacctcttttttcatagcatatgtatttttgcttattctatacaaaaaaatggaagcactgtccgcttccatttttaagtcatctcaactattatgttttgtttaaaactcacattttcccgcagtcctcggaaacggtatcacatcccggatatttgccattcccgtcaagtacatcaccattctctcaaatccaagcccaaatcctgaatgtctggtggaaccgtactttctcaaatccagataaaaatcatagtcagacagattcatttccagctcgcccatccgcatttgaagtttctccagatcatcctctctctggcttcccccgatgatctccccgattcccggcaccaaaagatccactgccgccaccgtctttccatccggattctgtttcatataaaatgccttaatctccttcggatagtctgtcacaaatacaggtttcttaaatactttttccgtcagataccgctcatgctctgtctgtaaatcagttccccaggataccggatattgaaacatattattgtgctctttcaaaatatctatggcctctgtgtaggtaatccttgcaaattctgactccgccacatggtgcaggcggtccagcagacctttgtctacaaatttattaaaaaatcccatttcttccggagcctgctccaaaacatattgaatgatatatttgatcatatgttccgcaagcagcatattatcttccaggtctgcaaaagccatctccggttcgatcatccaaaattctgccgcatgcctggtagtgttgctttcctccgcccgaaatgtcggtccaaacgtatagatatttcggaaagcctgggcaaaggcttctccattcagctgtccgctgactgtgaggctggtttctctctcaaaaaaatcttctctgtaatccagctttttaccctgggaaagttcctccaggtcaagcgttgtcacctgaaacatttcccctgcgccctcacagtcctgtcccgaaatgatcggtgtgtgcacatagacaaaatctctctccataaaaaacttatggatagcataggcaatcagcgaacggactctgtacaccgcctgaaatgtgttggccctcggccttaaatgggcgatcgttctcagatattcaaacgaatgccgtttcttctgaagcggataatcagacggagattcaccctccacttctacggactctgcctgtatctcaaacggctgtctggcatccggtgtctctgtgagaattcctttcacaatcaccgcggtcccgacagacagctttttcacctcagtaaagtttgaaagttctttgccgtatacgatctggattggttcaaaaaaagttccgtcgttgatcacaagaaacccaaagtccctggagtcccggttgctcctgacccatccgcacagactcagttctttctggttatactctttatactgtttataaatctgtctccctgttaatatctgcacttctctgcttctcctcttaaaatttaaataaattcaatccgatcccgccgctgtattcccggtccacggttccttcgatctctgtaagcaccaattccccggtagcgctgatataggcttctgtaagatgtcctccgcggacttctcccgcttcattggcgacactgatatggaagtgtagataggtttccccattcatgcgggaaacattaccgccaagtgaaacaatctccatatcttcctcgtaagttctgcttacatacttcttttctcctgtcttaaataaacctgcggttactttatttacagccccgatacctgacagagagcccagctttatattttctttttcacataaatctttgatggatgatacaatctcttcccctttttccagccttatgacatattgctttccaaacttacggtattccataagaatccctcctcatattcatggttacagcgagtagtgtctttcattattatagaaccagagcagggatctttcaagtcatggtatctcccaaaactttttctcagagaaacctggaatgcagctttaggatctgccttgctaatggagccgtaacgataagagagctgatgattttcctgcgcacggcaatatagattgcttccgctttttctgtctcatatgcagctcctatcacttccggaatctgctggagatcttcaaggctgagcgtcatattttgacggttccacggacagtccagcagccgtccctgaagatcatagaagttataaataagatctcctttcactttatctttcatttcggtttccatacactgctctttttcgagatagaggtttgtcatttcaaaatatctgctgcctgttccaattccgacaaaagcaatgtctgactgttttgctttctgaagcacttcttctatgaaccgctggctcataaaaatatcttttgcctcctttgaatcgacaacaataggggcatgcagctgaagacctgaggcaccgcagtggcttgcaaagtactcacataccgtgttggcctgaatatcccataactccttatcaacaccgccgcacagcggaacaaaggtcacatgttccaaaggaatcggggatgtgaacttcattgccgtttcccttgccatccgtcctccggaaactgccgcatatttcacattgggcagccttcgtgcaagatactttccggcctgaagtgctgtacattcttcctctgtctgaccttccataggctctgcacagatgatttcctttaggccgaagattcccttcatacgttcttctaattctttgtgggcatggatcttatcatcatgaattacaacttccacaaccccgctcttccttgcctttaccagcaccttcgatacgagagaacggctcacgtgaagtttcctggcaatctgctgctgtgtcagctgtttctcataatacagatgcgcaacatcaactaaaaacttcatttcctctgtgcttcccataaacagttcctttccctgagactacacatattcaatattaaaagttttattggatatctgcaggcacttcaagtcttcatattccgttgctccgtgggccgtcacatacccttccggataccagataaaggttcccggcccataaagctcatctccggtctgtaactgaccctccagaacaaaaaatccatgacccgccgtgtgtctgtgattgatcgtggtaaaccccgccggataattcatataattgatctgcatgcctgtctcatcatccaatagtaaagccttttttccaaatagtttccctgtggtcgtcgtcggccggtaaaaccacggcattcggtttacatccatcacttttttctcaagggagttttgcctctgttcttcctcctcaagatattcaatggaaaatgctttgttggagatcagtagacacttcaggtcctcatattctgtcgctccatgtgtggctgcgattccctccggataccagacaaacgttcctggtccgtaaagctcaccgtccgtctccagctgtccctccagcacatagattccatgagaagccggatgtctgtgaagtaccgttgtaaatcccttgggataatgcatataatcaattaccatctctgtctcttcatccagatgcagactctttttcccgaatatctttcctgttctgctgtttgcccggtaaaaccatggcattctccccaaatctttcactgttgttttcagttccataacaaactcctttccaacgagtttttctgcttctgtctttaaggtaacttgattttaccgtttcgtcaattatgttttttcccttgtgtcatttgacacacctgtaagtattttatttctatttaaccatagcaaaaagggcacagccataaaaatagctctgcccttttttcataagattgtttttattctttgatcatcgtaaagtcatcccaaggaatattgacctcagcaccttcattgatgatagaatcaacatgcatcagaagcgggaactcatccagggaaacgactcccctctctgcaagtttccttacggcacgtgcagttctggttgcaatcacaatggactccagagtcacgccctgtaattcttccatagcctcatcgaagcttaacccgcgtccgagaagggttccgatcttccttgttcttccgccgaagaccgtcacatacagatctcctgccccgtgaataatattctccgggcctccgccgatcagttccaaaagtcttgtcatttcttttacgctctgtccaaacaatgctgcctgggaattgtagtgctggataccgatctttccttccattttttcagaaagacccacagccagggttacaccgagtgcatatgcattcttcatggctacggcgcactccacacctacgacgtctttagaaagagtgatgtgatagtagtctgttgccaaaagctctttgaacattttgagagtttccatgttctttccgcagaaagccacatggctgtgatcgtggtctgccaattcatagctggtacacggaccgccgatggcattgatatcaagatgctttccttccggctggcgttcctcaaagatcaccggatatggaaccagagttccgtcatccagatctaccatgcctttcgtcacagagaggagcggtacactttcagggattaccggaagaatctcatcacaaaaccagtctaatccaaagctgctgacaccgcagagcgctgcgtctgctccgtccagagcctcttctaattcttcaatctgataatatttgatcccgtcgtgcagggtcctttttaatgtgatatgaaaattatccttctttaatccgtcgataatgtcccgatccagcggggaaccaaccaagcggacctcgtgtccgttttccatcgccggaaatgtaattgctgatgccatctgtcctgcacaaataaatgtaataacgctcatgttttcctcctataatgcttatgctgttactttctttgttgccacaatatctactcccagtccaagaacgtctttgataaccacatcgcccacattcaccggggccttagctgtcactttggtcagctcatccatgatatcataaatcttccctttcggaatatccccgtttgttttcacagggactcttctcgctgtctctgcctcaaccctcacggtagacgtgatgactctggtaggattgactaattccttttccccgtatacggcgcctctcggacagccgtttccggttactttatatccgttttcttcatcgacttttaaatgacatcctttcggacaaacaatacaaattaaatctgtcatgttaagcacctaccttttctacagacacagtgatctcaccgttcttcaccttatctaaaaacgcttttggtatcacgattttttccatctcacccggagccatatgttcccttttaaaggaagccagttcctcacctgctgaagtgaccttaattgccacatctttgtatacgtttctcacccggaacatgacttctaccattttatcaacatttgcaggacgaatcttctgaggaactgtatatcctacacagtctccgtttttcagttcaatatatgtctggtcttcggtctcgccgtttttcacatattctgcggcacttcttcccgccttctgactctcggctgtaacaaagtctaccaggtcatgaacatgcacaacgttgccgcttgcaaaaataccttcagcggatgtctccatgttttcaaatacgaccggtccgtttgttctcgggtccatagtgattcctgctgctcttgtcagttcattttcaggaatcagtcccacggataaaagtacggtgtctacatcaaatatgatttcggttccagggatcggctggtttttctcatccaccttctgtacggtaacctgctccactctcttatcccctttgatatccgtaatcgtgtgggataaatacagaggaatatcgtaatcttccagacactgcacgatgtttcttgtaagtccgttggaatatggacagagttctacgcagcccacaacctttgcaccctctaagctcatacgccttgccatgatcagaccgatatctccggaccctaaaataaggacttttttccctaccatgtagccctcaatgttaacatatctttgagctgcacccgcagtgaagactcccgccggacggtctccaggaattgcaatggctcccctggtcctctcccggcagcccatgtttaagatgagtgcctttccttccaggaccatatagccgtttttcttattcattgcatgaacgcattttttctcttcatccacatccaagaccatagtatccagcatcacttctatatttgtctcggctaacatttcgatgaatttatttgcatactctggtccggtcagttcttctttgaagtaatgaagtccgaatccgttgtgaatacactgatttaaaattccgcccagttcctggtcacgttctaccactaagattttatcggcaccatttttactcgcttccactgctgccgcaaggcctgccggtcctcctccgactacgatcacatcatacttcattattcggcacctcctgtttttgtttctcctgtgataatgttcattcccacacggtcctgaggaacatcttccagcggaatgtttaattctcttgagatgatctcctgaactctcggtccgcagaaaccaccctggcatcttcccatacctgcgttgcatcttctcttgactgcatcaatggatgtggcagggatcgggcggtggatcgcgtccacaatctctccttccgtcactgtttcacagcggcagataatttttccgtacaatggattttctttaatcagcgcggctctctcttcatcactcagcttcttaaaacgatttacttttctctcgtccttgatttcttcctttgctttcagacaaagtcctgactcttccatcatctttaacaggtcaactgcgattgccggtgcagaagaaagtcccggagaggccattcctgaaatattaaaaaagcctttgttttcttcatcttcaaatatgaagaagtcatcctcttttgttcttgcacggactcccgcgaaattcctgatggattctctgaagttaattccaggcacggattttaaggcagtatttcttacaaagcttaatccgtctgtcgaagttgaaacatcgtctccgtccgtaggctgtgaattcggccccacaatcaggtttccgtgtacggtaggtgatacgaggacaccttttccgtctttgttcgggcactggaagattacatggtttacaagttctccctggcttttatccaataagtaatactcacctttattaggcttgatcgtaaaggattttttattcgtatattcgtttactttgtctgcgttgactcctgccgcattgcagatatattttgcctcaacggttccgttgttggtttttatttcataagaatcattgttctttttaatatctgtaacctcggtgttcagcttaaattcaacaccgtttaaggcagccatctctccgagagcgattgccagctcccacgggctgatgattcctacatttggggaaaataaagctttgacagctttctcagaaatatttggttcttcttttcttaaggtttcctgatcccagatctccatatccggaacaccgtttttctctccacgctgttttaactcttctaaggttttttcttctttttcttcaaaagcaacaatcagggctccgatctgtttaaatggaacatccagcttttcgcacagctcttttatgtactgatttcctctgatattgtattttgccatcagagatcccggtatcgggtcatatcctccatggatgatggcactgtttgctttcgttgtgccgacagccacatcattttctttttcaatgaccactgcatttacattgtactttcctaattcatatgcgatggaacatcctgtaatccccgcacctataatcgctacatcatacactgttcttatcctccttcgactgagtccctgtttgtcttactgcccttatctaatcataataatctggccctgtcaaacgtgccaaaccgccgttttatgcggctttcgcccacttttgattaatcatagatcattgattaacaggccttttcctcttttatttttttcagatcagacactttcccctgttttccttgtgtttgttattaatcattagtataatattaataatcaataaaaagtttcaattagtaatttttattaatcaaaataaatcgaagatatttccacttgacaggaggggtgttatgggaaagagaaataaagtcacaacgagggatattgctgagtacacagggctctcccagtccagtgtttctatgatcttaagcagcaagccccatgtctccttttcaaaagagacgatagataaagtaaaagccgcagcaaaagaactgggctataagaaaccagagaaaaatacgttaaaaaaagcatccgcactttccaaaacgatcatcgtcatctgccctattctgtctaatggctattactccatgctgatccattccatcacagagcgggccagagaatatggctataccgtattttccgtatccacgatccgggatgtgtctcaggaggagtattacataaaaatgctttcaaactttgatttaagcggtatcatttttctgtaccctccgtcttctaagatatcagagatcaatgcactgtccaagtcagtgcctatggtttccatcggtgacaaacctgaaggctcccgttttgattcggttgaattggacagcaaaaaacccggtttcatacttggtgaatatctgatctcactcgggcacacccatgtttcttttgtctcagcaccgatcaaacaaaaagaaatcggaaggcttcacaggctggaagggttaaaaaacagttttaaggcatacaattttgatttaaataatatagaggttctttcatccaaattttctacttattccagatatacaccggataattccgaatacttaaatggctataaccttgtctcaaaggccctggaaaatcacacgaaatccactgcttttgttggaaacaacgatatgaccgcgttcgggatcatgtctgccatcacagatcacggctataaaataccgggagactattcggtctgtggttttgataatatacctctttcgggcatgccccagatctcccttacgaccattgaacatgcggctgcattcaagggcaaagaagccgtggatattatttataaaaagaatgcgcagaaagacgggatttcaaaacaccattatattatgaggctggaatatgaaccggaactgattgtccgaaattccaccggaaaggcaaaaaaataaggaataatttttacgattgccactactattacttaataaaagaagacaagaaagatgaattgctgttttgttaatagtataactcgtcttgtagacaatacacttcttttagatttaggagaagatattggtaaagcacagatagaagcatgtgaaatctctgaagttttagatgctatgaaagaaatttctgacaatggtaatcctttattatagctataatttcacgttttaacttcacacaaattattagggatgcgtttttacttgtttgaaaaccatccctttttttgttttgaaacaaaattatgtcacaacctccgatgaaaaagatagcattagtctgtatttacatccatacaaatcataagctatgataaatacagataaacgtttacagcaaacagcagccgcccgggaactggctgctgcccaacaaaggagaggtgagcatggccggcaaacttcttgatgatgaattcttaaacaacatagcatggggacttccaagtacagcaaagaaagatgcaatctgcattgcaggcagacttcttgtatccaacggatatgtgaatcccggatatgaagacagcatgatcgaacgagagcttgaacacaatacatatttagggttcggcgttgccatacctcatgggaatgaaaattctctgaatcaggtattaaaatccggaatctgcattgcacactttcctgacaccatagattacaacggtgaaactgtaacctatgtgataggaattgcatgtaaggaagaagacactatacaggaactgatgcagattactgatatcctctgcaaaccggaggaatgtgaaaaactattatctgccgcatcaaaagaagaatttatcaggatcatcaatgagaattatttaaaagaaggagagttatagtatggaacatgaaaaaacaacattctcccagaagcttcagaagttcggagcatttctggccggaatggttatcccaaatatcggcgcgttcatcggattcggtttgatcaccgcattcttccttgaaacaggctggacaccaaatgcaaagcttgcaaacctgatcagcccgattcttaattcactgcttcctatcctgatcggtcacaccggaggtaaaatggtcggaggagaccgcggaggcgtcattggtgccttagtaacggtcggtgccatcgtcgcagtaccgggaactcctatgttcctcgcagccatgatcttaggtcctgcatccggatggtgcattaagaagttcgatgcagcggtagacggaaagatccccggcggatttgaaatgatcgtcaacaatttttctttaggtatcatcggcggtattctctgctgtgtagcttaccttgtcttcggtcctgtcatggataccgtgacccaggtactcacaaacggagtaaactggattgtatcccacaatgtacttcccctttctgcaatttttgtagaacctgcaaaagtactattcttaaataacgctttagaccacggtatttttggaccaatcggttacgagcaggttaaaactttaggacattcagcattgtttttattagttcctaacccaggtaccggtctcggactcctgcttgcttactggttcttcggaaaaggcgagatgaaagaagccgctcccggaatgattcttattcatttctttggcggtatccatgaagtttatttcccatatgtattagccaatcctctcacaatcatcggtatgatcgcgggtggtatcgcaggtaccggtacatttacgcttctgaatgtgggaaccgttgcaacaccttctccgggcagtattttctcagtcctggcactgtcgcccaagagttctatgatcggtgtcattgcaggtgtggcaatctcctgtgccgtgtcttttgtgatcaacgccttctttgtaaaacgaatggtggcaaaaggaaagggagaagcttctttaggtccttctgtcattccaaaagaagctatgggctccagtgcttccagtacatctgatgccgtgacaaatgatgcttctctcggtgttgcaggcttagatcttacaaatgtaaagaagattgtcgttgcctgtgatgcgggtatgggatccagtgcaatgtctgctgctgcattaaagaaaaaagtaaaagcggctgacctcccggttgaagtcatcaacaccgcgatctccaagattccggatgacacagacttggtcatcactcacaaagagctgacaggtactgcaaaagcagctcagcctaacaagcagcatttatcgattacaaactatcttcaggctccggaatatgacgaactcgtagaacgtttaaagaaccgttaagctgagtactcttggtacaatccaaataataagcatagcaaatggagcgggcgtttccttccggggaaatgccctgttccggtattttgggagggaattcaaatgaaagcagttatgtatggggcaggcaatatcggacggggctttatcggtgccctactctcacagaccggctatgaagtcgtatttgtggatgtaaatgatgacgttgtaaataccattaacagagataaaacttatccccaggaaattgtaggtgaaaacggaaaaactgtctggatagaaaacatacgggccgttgacggaaaagatacttccactgtcagtgacgaaatcgcatctgcgaaccttctggctacttccgtgggtgtcactgtactcgaaaagatcattccggttatctgtgagggtctcaccagacgctgggacaaagatcctgacaacactctggatcttttgatctgtgaaaatctaatggatgccaatgaatttttatatgaaagaatcaaagacacactgcctgacagacataaaaaaactttggatgaaagccttggacttgtagaaacttccatcggccgtatggtgcctgtaatgacagaagccatgaaaaaaggtgatcctctccggatctgtgtggaagagtatgattatcttccggttgaccgggctgcttttaaagggccaattcctgactatgaaaaaatagtccctttcagccctttttctttttatctggaacgaaagctgtacatccataacatggcccatgctgttaccgcatttctgggaggaataaagggatatacatatattgacgaaagtattggtgatatctatatacgaaagctggtggaaggtgctatgatagaaagtgccatgatgatctcaaaaaaatatcatgtagaattttcagagctgaaagctcacatagatgatctgctgttccggttccaaaaccctgatctccatgataccgtggaacgtgtgggaagggaaccgatccgaaaattaaagccgaaggatcgcctggttggggcactgcgcggctgtgaacaggaaggtattctccctgtttatctgtctttttccatagcagctgccctatataatataacggatgcttccgctcacgagcttttaaatgaaacatgccaaatttcatccgatgaaccctgcggcagctatatcatggcattttatgaaaagttgaaaaattcacccaaagattttgcatctattttaaagatgattgacagacaatataatgaaatcagagggcccgttatttaaattcaataatccattttatcagagaggaagataggtgaagatatggttatttctgaccgcgcaaaagaaattatcgaatatctgctggatgcaaccggttatgtgagggtttcagagattgcaaaggaactgggcgtcacagaacgcactgtttaccgtgaaatgcccgaaatcaacaacatcatggaatcctgtgatttaaagctggaatcacagtccggcaggggaatgcagatctatggctccctgtataatatgaaacgtctggagtccctctttgaggaatccaaagtagaacagacttataccgcaaaagaacgaaatgatctgatactcctcatccttctccacgagaatgattatgtaaagactcagtcactggccatcgatctgaatacatctacacagacgatcagaaatagtctgcaccagctgcagaatttccttgaaaatgatgatatcaccttgattacaaaacgcagtgaaggtgttatactaaaagggaaagaaatatccaaacgtcacctgttaatcagtatacttctgagaaatattcctctggataatttctttgactggatgaaaaacaaaaaatataaaagctgtgcctttatcaatctgctgattcaatgggattatgaagacacattatctgtcatctatgattttctggacccgctgatttcaaaaaagagacttaatgtatccgataaagaatttcaggagtttttattcctcctgtgtatttttatcaaaaggcattctcttgtagatgagaaaggggacgagttaaagctctcggtggatataccaaatcctgagcaggagctttacaaaagtatcaaacacctgctggaacataagtttcatattaagctctatgatacagagcttaactacttcaactggatgatcaacctgtatacaggacgcactcactaccatgtcgcaaatgattccagcattttaaaacagctggatctggtcacccagctgattgccagagtagaggaacggtttggtttcccatacagcgaagatgagaaccttgccgagaatcttatgcttcacatcaatatggctctggaacggatcagaagcgggatgaacgtatccaatccgctcaatgacgatatttatcagtcccatccaaagctttatgatattgtgaagcagagttttatagaagtttttaatcacacctccgtaccggtgccggatgatgaaataggatatatcgtcatctactttattgcatcgatggagtatctgaccaaacagtccattgaagtcctggtcgtctgtgcctcaggcatgggttcatccaagatgttaagaagccgtctggagcgggaatttgcagagatcggcgtggagaagatcatctctctccataagctctccgatgaagacctttcccgctacgatctgattatttccacagtaccgctggatttagccgacgataagtacatctgtgtatccccgctgctcaacgacagggacaaggaagaaaccagaaaacgcatcaaacacctcaataaaaaaggagaacatcatgaataagattttcaacgcagacaacattgttttaaacaaacgcctccggaataaggaagacgctattgacgtggcgggtaaagttctggtggaacagggctatgtagatccaaaatatgtagaatgtatgcacaaaagagaagaagtcatctctacttacatcggcaataacgtagctatccctcatggtatcgacggttccgaaaagtacataaaagaatccggtatatcctttattcaggtaccggagggtgtgaaatacggcgatgacaccgtatacatcgttatgggtgtcgcaggaaaagacggaacccacctggacatccttatgaagctctctgaagtaatctgtgaagaggaaaatatcaaaaaattaaaagaagcacagaccaaagaagaaatcctggacatcatcggtgacctgaccgtttaatccagccatttaaaccagctataaattacaaaaaggagatatattatgttaattttaattgacgacgcagacttaacaaaaatcggggaactctatgcaaaatatccttatgacggagttaccaccaatcctacgatcttaggcaagacaggaaatcctgatcctatggatcagttaaagaaaatccgtgctttgattccggaagaagcgatgcttcatgcacaggtactttcaacagagaccgacgacatggtaaaagaagcaaaacatatggttgatgccatcggcggcaacatgtacattaaagtacccgtaaccgcaaatggattaaaagcgatttctatcctgagcaaagagggaatcaatgtaaccgcaaccgctatttacggtgtaatgcctgcattcatggcggccaaagctggagctaagttcctcgctccttatgtaaaccgcctggacaacttaggatacaatggtgtgcagatttcaaaagatattcatacgatggtcaaggccgcaggatatgatgcggaagttctcggtgcttctttcaaaaactctcagcaggttcttgaaatgggcaagttcggtatcggatctgtcacagtcaatccggatactttgaaaaccctcgcattcaatcaggttgctgaaggtgccgtaaaagacttcatccgcgacttcgaaaactgctgtggtgaaggaaagactatgcttgatttctaaaaaatctaacaaaaactccggagcgcatattttgctccggagttttttatttatctcattataataattctttgcgcagttcttctcctgttttctcactcaggtatgcaggtgcaatatcaaaaacagttttgcatcccgtctgtccctctttggcaagtctgtaagcggccctcgcataagacacaatgacactggatgtaaattcaggattggagtccagcttcaaactatattcaatcagatgcttattttcgttttcccatccggtctttccgcttcgcagaacgaatcctccgtgaggaatactgctgtggtctctttttaattcttcttcactgataaaatgaacagttgtatcgtagtctgcaaaataattcggcatatttttgatctctgcctctattttagatgcgtctgctccttcttccagcacgacaaaacactctcttgtatgtttctcacgggttgtgagttctgggtcctctccgtttctcactgcttcaagtgctgtttctacgggaatggtatactgctttccgtcttttactccatcgatccggcggattgcgtctgaatgtccctggcttactcctctgccccaaaatgtataatcttttccttccggaaggatggcattcgcatacattctgtttaaagaaaacattcccgggtcccatcccacggaaataatccctacgtttccgccttcttttgcggctttatcaacattagcaaaatgctccggaattttcgcatgtgtatcaaaactgtccacaacattgaatatagaggcatattccggcgtctgtaccggaagatctgtggcactgccgccgcacaggatcatgacatcaattttatccttccagtctgccgcattggctacactgcacacagcagccgactttgtgaggattgttacatcttctggatttcttcttgtgaaaactgctgcaagttccatatccggattctgacggatggcacattccacaccgcgcccgagatttccataacctaaaatacctatacgtatactcatattttttctcctgtctgttttttttctttttttgattatacttgcttaaatagaattctgcaagaacaaaacatcctgtaattcatattttttcctgctctatacagggttatccgagaattttaccggatatcttctatataggtaaatgcttatgaatacagttatcgtttctgcagctaaaaaagaccaccagattccttccataccaataacctgtgaaagaatccacatcaatggcagcagaagtatcagctgccttaatatattgatgataaggctgaatccaactctcctggtcgactgcataaacgatgcagtcattgtgcccgccgcggcaaatacataacttgtacacataatttttaatgcaggcactccaaatgtcatcatttcatcggatgcattaaaaatctttaatatctgttccggaaatgtccaaaacagaacaatactgatacctgtaaggacaattcctattatggttccatatttaaatgcctgacgaagccttggcatattttttgcaccataattataactcataatcggtatacacccttgtacaagaccgtttaacgtcataatgacaacttgctgcagtttaaaatatgccccgaaaaatgccactgcagtcgtggaatatacaacaagaaatatatttgtaaagtaaatcataaatgctcccagggcattcatgataaaggatgggaatccgatcacaaaaatttcttttattatctggaagtcaacatgaaatccctttattttcagcctgaccttttgctttcgcaaaataagtaccataaaggctaaaatcatggatagcgtatatccgcatacagttgacacagcagccccttcaattcccattttaggaaaaccaaaataaccaaatataagaatgggatcaagtataaagtttaatacaactcccgcaatctgaaaccacataggcgcgatcatatttcctgttccctgaagaatcttttgtatacatatatgtaccatactggaaacttccaaaaaagcacaaatcctcatgtagcgaacggctaaattatatatttccggatcgtctgtaaatgatgaaaaaaagggttttgttatcactagcacagcgccggtaacgataattcccatagcagctgagagcaatatgccatttgttacaacactgtctgccctgtcctgattcttctgaccaagattatctgcaatcagtacattaacacccacaccgatccatatggacattgcaatcatcagggttgtaattggaaaggccagagacacggcagtcaattccttctccccaatccatgagacaaacatacagtctacaaaattgtatgtatactgcataaacatcgatatgagcggaggtaccgccatggatacgatcagcggaaacatctgtctggtctccatcttgttcttatgattcataaaccctcctctaaataaaatacaaaattggaaagcacgcttcatcacgcatctgtgtacagcccgcggagcgattttatttcataggaaagttcgcgaacttctctatgaaataaaaaagccggatatctttcgatatccagactattttagagttgcgggggccggatttgaaccaacgaccttcgggttatgagcccgacgagctaccagactgctccaccccgcgctatgaaagtaaaaaggcgccaaccagatttgaactggtgatcagggagttgcagtcccatgccttaccacttggctatggcgccatatattatatagtatatgtgaacgtatctaatttatgatacgaaaaaatgactccaacgggatttgaacccgtgttaccgccgtgaaagggcggtgtcttaaccacttgaccatggagccttgtttctttgaccgcttcacggtcttactaaactccccgagctgggctcgaaccagcgacaacacggttaacagccgtgcgctctaccaactgagctatcgaggatcattcttttttattctttccttttttctcttaaatataccttgtaatgcaaagcatatcgtccgtaggacatgtaatacgggatgccctgtgggtataccttcaaaactacatacagaacttatccatcaaactttcttccttacctttccttggttaaagcctcgaccgattagtaacagtcagctccatacgttgccgcacttccacctctgccctatctacctcgtcgtcttcaaggggtcttactagattactctatgggaaatcttatctttaggggggcttcacgcttagatgccttcagcgtttatcccttccagacttggctactctgctatgcatttggtaatacaacagatccaccagtggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccacgttataccaccggatcactaagtcctactttcgtacctgctccacccgtcggtgtcacagtcaagccttcttctgcctttgcactctgcgaatggtttccgtccattctgagaagacctttgagcgcctccgataccctttcggaggcgaccgccccagtcaaactccccacctgacattgtcccccaaccagatcatggctgttggttagaaatccaatactgcaagggtggtatcccaacagtgactccaaaaggactggcgtccttctttctcagtctcccacctatcctgtacatgcagtaccgaatcccagtatcaagctggagtaaagctccatggggtctttccgtcctggcgcaggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcagaccttcgcgatcactcgctaagccctccccttaaccttccagcaccgggcaggcgtcagcccatatacttcaccttgcggttttgcatagacctgtgtttttgctaaacagttgcttgggccaattctctgcggccatatcgctatggcactccttctcccgaagttacggagtcattttgccgagttccttaacaacacttctcccgtcggccttaggattctctcctcatccacctgtgtcggtttacggtacgggcacataaaaaacaatagcggcttttcttgacagctgggggcctgggcttccctacttttgttcggtccgcgtaacgcctttgccttgcatgggggttttgcctcccatacggctccttcgcttgcgccagtttttccattcctggctcccatttcccttctgtgtccccacagttctgtttttatgtggtactggaatttcaaccagttatccatcgactacggctctcgccctcgccttaggtcccgacttacccagagcagatcagctttactctggaaaccttagatattcggccggaaggattctcaccttcctctcgctactcattccggcattctctcttctaagcagtccaccactccttacggtatggcttcatcccgcttacaatgctcctctaccaatgtattactacattccacagcttcggtgtcgtgttttagccccggacattttcggcgcaggatctctcgactagtgagctattacgcactctttcaatgtatggctgcttctaagccaacgtcctagttgtctttgaaatcccacatccttttccacttaacacgtactttgggaccttagctggtggtctgggctgtttccctttcgactgtccaacttatctcgtacagtctgactcccatcaatcatctggctggcattcggagtttgatatgttttggtaagctttgacgccccctagacaattcagtgctctacctccagcagactttgatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgccctcactgactagtttcgcgctcttaacgcttgctttcacttcggctccggaccttaagtccttaaccttgccagtacgggcaactcgccggaccgttctacaaaaagtacgcagttccccatctaaaggggttccacagcttgtaaacatagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcctgctagggtacttcagacttcggatacggggctttcaccctctctggccggccttcccaggccgctctcctgtcctacataatcccacatcgcagtccgaaccccaggatgcacgcatcctggtttgggctctttccatttcgctcgccgctactttggaaatcgaggtttctttctcttcctccgggtacttagatgtttcagttccccgggttccccacgcatggctatgaattcaccatacgctgacagaggttcactctgccgggtttccccattcagaaatctgtggatcaaaggatatttgctcctccccgcagcttatcgcagcttatcacgtctttcatcggctcttagtgccaaggcatccaccctacgctctttctactttaaccatagaacggacgatagttgttctatcatcctcattgtcatctagcgtgatgacaacgggtaattcgttttgtttgatgtcttgtcatttcttataaaaaataactttttgttctgtatgaagttttcaaggtacatccgcgcagcaaggattgcgtgcacaaaaagggaaggatatcacgtggagaattcattctcctaagcgcatatgcttttctttttgtataagcggctctgccgcgatcgaagaagcgaagcttctgagattcacgcgttaccaccaacaatctctgttacgctgctgggcttgagtggactcgaaccaccgacctcacgcttatcaggcgtgcgctctaaccacctgagctacaagcccatttggatatggccgttccttccggcccatcatttaattgtagacaatcttcattgtctgcctggagaatgcgagattcgaactcgcgacctcctgcttgcaaggcaggcgctctcccaactgagctaatcccccatataaaaatccggcagccacctgctttcccaggtcgtctccaaccaagtatcatcggccgttttggtcttaaccatcgtgttcgggatgggtacgggtgtgcccccaaaacgcatcgccaccggaaactttgagtacttagcgaggtcctttcgagcttagtacgaaagttgttctttgcaacttaatgagccagccagttatggcgcagcgaatttagtgcaatagaacttccttgcttgatactttttgttatctttcctgaactgcactctcgcagttcctcattgataactaaacaataagacaacccctacttcttcttccttagaaaggaggtgatccagccgcaccttccgatacggctaccttgttacgacttcaccccagttatcggtcccaccttcggcagctccctccttgcggttgggtcactgacttcgggcgttactgactcccatggtgtgacgggcggtgtgtacaagacccgggaacgtattcaccgtgacattctgattcacgattactagcgattccagcttcatgtagtcgagttgcagactacaatccgaactgagacgttatttctgggatttgcttcgcctcacgacttcgcttccctttgtttacgccattgtagcacgtgtgtagccctggccataaggggcatgatgatttgacgtcgtccccaccttcctccaggttatccctggcagtctctctagagtgcccaccttaaatgctggctactaaagataggggttgcgctcgttgcgggacttaacccaacatctcacgacacgagctgacgacaaccatgcaccacctgtctccaatgtctcgaaagaaaaaaccggttaaggttcgctcattgggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgtttgctgcggcaccgaagcctctacggccccgacacctagtattcatcgtttacggcgtggactaccagggtatctaatcctgtttgctccccacgctttcgtgcatcagtgtcagtgacagtccagtaagccgccttcgccactggtgttcctcctaatatctacgcatttcaccgctacactaggaattccgcttacctctcctgcactccagcatgacagtttcaaaagcagtcccggggttaagccccgggctttcacttctgacttaccatgccacctacgcaccctttacacccagtaattccggataacgcttgccccctacgtattaccgcggctgctggcacgtagttagccggggcttcttagtcaggtaccgtctgttttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcactctctcaagccggctactgatcgtcgccttggtgagccgttacctcaccaaccagctaatcagacgcgggaccatcctatactgccagggcttttcacactgaatcatgcgattctgtgcgcttatgcggtattagcagccgtttccagctgttatccccctgtatagggcaggttccccacgcgttactcacccgtccgccactcagtcatataggaaatccatccgaaaacttcaatcctaaatgcttcgttcgacttgcatgtgttaagcacgccgccagcgttcatcctgagccaggatcaaactctcatgttcaatcttggatctaaaaagcgctagcttttttatccttgttttactgtgtcctttatataaagaacgttcgtgtatcttttttataaaagatactgaaaatctcttagaattttcaaggttgtcttattgttcaattatcaaggttctgctgtcgttttttgtcgtttctcttgcgacagctatattagaatatcatacttatttctctgtgtcaacaacttttttcattttttacaaattcttttttgaatttataaaaacggagaaggagggatttgaaccctcgcaccgcgcaaacggtctacacccttagcaggggcgcctcttcagccacttgagtacttctccaaaagcgcctaaacaattatgttatgatactgcgtcttcatgtgacgcttgaatatattatcaaactcccaactctttgtcaatagattttatgaaataatttattaaaaattggaatataattctttactactatatatagtagtattagcatgtatttctcacaacttccagatttcctgaatatgagttttgatatatctgacttcccgtaaactgcttttccccgctgctgtaaagaacaaacagcggagaaaaggtgtatttgctatattactttaaatgattcagagcattggataaaggaatttcagattcggataaatctgtctgaaaatcttatatcgtttttcgtactttttgaccagttctgaatcgggctttactgtatccacgactttcaccaatttctttgctgcctcttccacagaatcgtactcgccgcatccgactgccgcaagaatcgcgccgccatatcccggaccttcttcgctttctataatatcaacttcaagattcaagacattagccatgatttttctccagagcagactctttgctcctcctccgcagatcgttgttctcttgatatcaattcccagggattttgccacttccagtgagtctctcattgcaaaagcaacaccttccaacactgccagtgtcatatctgatctctttgtgtccatagacataccgatgaatgcccctctggcatccggatcattatgcggagagcgttctcccatcaaatatggaaggaaaaacacatggttttctccaagattctgaacagattcctgctcttttccatactcttttgttccaataatatcttccatccaccatttattacaggatgcggcactcagcatacagcccatcaaatgaaaatgtccgtccgcatgtgcaaaagaatgaagagcattattttcatccactccgaagtttttacttgaaataaaaatagtccccgatgttcccagggagacattacatctgccgtcccccacggttcctgttccgatggccgctgccgcattgtcccctgcgcctgctataatttttacattttggggaagtcccaattctcctgcagcttcagacgttattgtgcccactgcttcataactctcgtaaatatccgccacctgttctctctttataccgcagatattcagcatttcttccgaccagcatttatgttccacatcaaacagaagcattcctgatgcatctgagacatcagtacaaaacacaccggagagacgataggcaagataatcttttggcagcataattttatgaatttttctgaaattctcaggctcgtgtttctgcatccataagatcttaggcgcggtaaaacctgcaaaagcaatattggcagtgtactgagacaatttttctgtgcccaccacttcatttagatacttacattcttctgccgtcctgccgtcattccacagaattgcgggacggatgacatgatcatctttgtccaaaacgaccaggccgtgcatctgtcctccgaagctgatgcccttgatctgatttttatccacaacatcccggaccaattcacgtattccatccacagcagcattccaccagtccacagggttctgttctgaccaccctggttttggaaatgaaattggatactctttggaaataatcttacaaatctcaccctgcccgctcattaacaacagcttcagtgcagaagtccccaagtcaagtcctatgtaatacatctttcagctcctttccaccattatgcaaatggattctcagacggatacagcattcccttcggctggttaaaatcgagctccgtctgctccactcccagatacttaaatacctcaaacagaagttttccaaaatgtccgaacgcaactgctccgtgatgcgggaagttcttttctatcagtatatgacggtaaaatcttcccatttccggtatggcaaaaacaccaatccctccaaaggatcttgtcctcaccgggagtacttctccctgcgcgatatatgctcttaattttgcatctgatgtgctctgaagccggtaaaatgtaatgtctcccggtatgatatcaccttccagtgttccctgtgtagattcctcgggcagcgttctcgtcatgatcagctgatttttcatttcgcaaaaagaaagcttttctgaagccgtatttccacagtggaatcccatgaacacgtctctgcggctgtattcataattatctttgatttctgtctcatacatatcatcaggcactgtgttgttaatatccagaagagtcacaatatccccgctgactgccgtgccgataaattcgctcaaagctccataaatatccacctcacaggacaccggaattccctttgctgtcagcctgctgttcacatagcatggaacaaagccgaactgagtctgaaaagcaggccagcacttccctgcaatggccacatacttcctggaacctctatgcttatcgatccaatccaggagggtcagctcatactgtgcaagtttaggcagtatctgaggttttttatttccctctcccagctccttctccatgtcctttacaacatccggaatcctctcatcaccctcatgtgccttaaaagactcaaacaaatccagttcagaattttcttcaatctcgactcccagattataaagctgcttgatcggtgcgttgcaggctaggaaatcctgtggtctcggaccgaaagaaataatctttaagttacgcacgccgatcactgcccttgccaccggtacaaattcatgaatcatgtctgctacttccccggcagtccccaccgcatattccggaatataagcctttacatttctaagctttaaattatagctggcattgagcataccacagtaagcatcaccccggtcatcggtcagcttatcctgtgtctcttcggctgccgccgcaaacatcaccggtccgtcgaattctttggccagtaatgtctcagccgtctcaggtccgaaattccccagataaacaaccaatgcgttgcatcctgcttttttaagctcttcaagggctttcttcatgtccagttcattttcaatacaagtctcacattcaaagatttccccgtatttctcccgataggcttttgcagcaagttttctcctgttctcggacagtgacatagggaaacaatccctgctgaccgctgcaattcctaaaactacttctggtatattttccataaacgtccctcctggtcaatggatttaagtaatcattttatctcttttattttaccattgttatgtcaaaagagccacaaaaacaagacgatcatcgcgcttataaatcatgaacaaaagttatgttaaatatttacattttagtgattatattgtaaaataatagatattattgaaataattgttctttcatgataaactaaaggagataaaacaaaagatgaagaaaaatatttttgtatccttaaaaaatgactatgctttcactcaagttatgaagcagcctaaagtcataaaaggctttttgagcagtatccttcacattcagcctgaaaggattggaaacattcatataaaagaccggcatttgcctaaggatcttccggaagataaattatctattctagatttatacacaattgttgaagacatagggaagatcaacatcgaaatgcaagtgttaccctatgcattttgggacagaagagtattctcctatttgtcaaaagtttatacacaagatttaaaatcaggacagacttatgattcatgtaccaaattaatacatatcagtattcttggattcaatcagtttacggatactgattacttttattcttcctttcatatgagagaagatcagcgatataccctatatagcgaccaatgggaaatccatgtgattgaattaaaaaaactgagccaatctgcagtaaaagatgatcataaatccctatataagtgggcatgccttatcagtgccgacagagaggaggaacgtatgataattgagaaagatccctatatcgaggaagccgtcaaagaactggaaaaactggaacgcgatcctgaacgtatggatgaataccttttccgccagaaaaatctatccgattacgctacacagatgaaattcaacaaagaattaggaaaggctgaaggaaaagctgaaggtgaacatatacttgcctctctgatgcagaaattatttttagatggaagaattgaagatgccaggcttgctgtcgataatgaaaatatgagaataaaactttataaggaatatcatttgatataataatttaatactaatatcatatatataaaaatccggcaagactataattattatcttagtcttgccgggtttttatatgttttaagcttgtttttctcttttaacgcctattcccaacttgtattacactgcttctgtatcacccttaagcccgtaaaacgccccttcaatatcggaatctttatgagcaatcagccacttgttccttgcgaacaaaattttatccttatccgttcttactttcatacaaaatggttcacttgtatgttttggtgcaatacagataagcttaaacccatatccgtttacgttgcatggagcacagtgaagtacgccgcagtttaactccacggctgtgcccttcgggacaaaaaacgcttccattctggatgtatgatactcgtgatttggttcgatatcctggctcagacccaggtacatgacacagtctgtcgctgcaatatgtatgactttcgacttgtgatattctacgccatgaattctgtgattatgcccgctcatatatccgatctgcaccggaagttcatgaaacagctggcactgaattttatggcacaccggcagtttctccatctcttcgacagacagctgttcttccagatattttgaagcctttatacggtccatatactgtttcagctggctgaaatcaaaatcttctattactctcccatatttattaaattcggggtcaaaaatataccttaacatattatctgctccttcttgtttttcattgctgagtttataaagaaaattcatcttcaatattctacataatactaccataaattacataaacatttcttttcattttctttaagtttttgtgaagtacaggtatattgttgacaatattttaaatattattccaaaaagtttgctttataatctactactgccgtctcatacaaattattcccatggctgtcaatcacaacgattaccggaagattctcaacttcaagcttccgaattgcctctgttcccaagtcttcatacgcaacgacctcagattttttgatacactttgacaaaagtgctcctgccccccctactgctgcaaaatagactgcgccattttctttcatagattcgatcacgtcctcagaccttttgccttttcctatcatgccctttaatccaagagaaagcatgcgcggagtatatttatccatgcggctgctggtcgtaggtcctgccgaaccgattacctggccttccctggctggtgtggggccgagataatagacaatctgattctttaagtttaccggcagttcctttttttcttctgccgcttcatacagcctcttatgagccgcatctctggcagtataaatggttccggtcaaataaacataatctcctgcccgcagatttttcagttcatcggctccggcgggtactgttacatatttatccatctctctaactccttataaaacccgatgtacatggcggttcacatgacagcatatatttacggcaagaggcattcctgcgatatgtgtcggataagtctcaatatttactccaagggcagtagtgctgcctcccagtccccccggaccaattcccagctgattgatctcctgtaagagttcttcttccaggatacggatatgttctttctcagatctctgatcaaggtttctggtcagcgctttttttgccagaaaagctgctttttcaaagctgcccccaagacccactccgacgaccatcggcggacaggcattcggtcctgcatccttcacggcttctaaaacagatttcctgacaccttccgctccgtccgccggtttcagcataaatacccggctcatattttcacttccaaatcccttgggagctactaaaatttcaagtttatccccggaaacgatatcgatatgcacaatcgcgggtgtattatctttcgtattttccctgatcagaggatctttcacgacagatttcctcagatagccttctctatatccctgtctgaccccctcattgaccgcatcgtggaggtccatgccctcaatatgcagatcctggccaatatttaaaaataccacagccatccccgtatcctgacaaatcggaatttgttcttcttgggcaattttcatattttcattgagctgggataaaatctgctttccaagcggagtcttttctgtctcttttgcatttttcagcctgcatttcatatcttctgataaggtcaggttggcttcaatacacatgtccctgatactgcggatcatctcatctgtatggatcgttctcatatttcctccaaaaaatcattctgtgatacgcgaagtcagagcacagactgctgatgccatgctctgacttttgatctttattctgtttcttcttctgaagtttcgctctcttgttccacttcttcatcccgtacttttgccaggcttgccacaatcacattgtcgtctaaattcatgagcttgactcccgatgtattccgtccaagcatagaaattccatcgactcccatccggatcacaacaccttccgtagtgatcatcatgacttcattttcttcatccacagccttgactccgaccacatctcctgttttctcagtgatcttgtagcagcggataccctttccgcctctgtgctgaggagtaaattcagtcatggcagtccgttttcccattccattttcagacacaaacagcaatgcttcaccctgggaattcagctgcatgccgataacttcatcgtctccatctaagttgattcctcttacacccatggctgttcgtcctatagatctgacatctgtctcatggaacctgatgcactgtccgttctttgtcacaagaaatacgtcctggtcattgtctgtaaacttcacttcgatcaattcgtcattttctttcagcgtaatcgccagaagtcctgtctttcttatatttgcatactccatgatcggtgattttttcacaaccccgctcttggtagccataaacaggtaatgatcctctttatattcattgatcgggatgaccgccgttatcttttcctccggctgcagctggatcagattcacgatcgccgtacctctggccgtccggctgctttctggaatctcataggctttcatccgatacactcttcccatatttgtaaaaaacataatatagtgatgggaagttgtcataaacaattcctcaatataatcctcatcaatggtctgcattcctttaataccttttccgcctctgttctggcttttgaaggtatctaccgtcatacgcttgatatatccgagttttgtcatagtaatgatcgtattttctcttggaatcagatcttccatggaaatatcgtctacatcaaatccgatagaggtccttctctcatccccatatttgtcacggatcagaaccagctcatctttgatcactcccaaaagaagtttttcatcggcaagaatcgcctttaattctgtgatctttgccatcagctcattatattctttttcaagcttggcgcgttccaaaccgttcagcgcacgcagcctcatatccacgattgcctgtgcctgtgcgtcggtcagggcaaaacgctccatgagctgtgtcttcgcctccgtgatatttgctgctgcccgaatgatcttgatgacttcatcaatattgtcctgggcaatgagcagaccttctaaaatatgagcccgttcttctgccttattcagctcatattttgtccttctggtcacaacgtccttctgatgttccagataataattgagcatgtcaaacagattcaggatcttaggttcattgtttaccaatgagagcatgataactccgaacgtatcctgcatctgggtatgcttaaacagacggttaaggacgacattggcattggcatccctgcgcagctcaatacagattctcatgccggtacggtcagattcatcccgtatttctgtaataccgtctacttttttatcttttacaagctctgcaatcttctgaatgagtctcgctttattgaccatataaggaagttcggttacgacaattctctgttttccgttggccatcggctcaatatccgtgacggcacggactttaatctttccgcgccctgtccggtatgcctgactaatgcccgcttttcctaaaatcgtcgccccagtcggaaaatccggtccttttacaatatctaataactcttcaatatctgtaacctggtttctctccacctgatcatcgataatttttacaactgcattgatcacttccgtgagattatgaggcggaatattcgtagccattccgaccgcgattccctgtgtaccgttgactaaaagattcggaaaccttgacggcagcacctggggctctttttccgtctcatcgaagttcggaataaagttgaccgtatctttaccgatatcggccaaaagttccatggaaattttgctgagccttgcctccgtataacgcatggcagcggcgccgtctccgtccacagaaccaaaatttccgtggccgtctaccagaggataacgggtcgaccactcctgagccatattaaccaatgccccatagatagaactgtcaccgtgaggatgatatttacccatagcatccccgacgatacgtgcacatttacggtgcggtttatccggcccgttgttcagttcgatcatcgcatagaggattctcctctgaaccggcttcagcccgtcccttacatcaggaagggcccttgcagcgataacgctcatggcataatcgatgtaggaattctccattgtctgcttcagatcaacgtcatgaactttatcaaaaattgtattctcgtccatatattatattccttcctatacgtccagattctggacatattttgcattggcttcaataaattcacgcctcggttccacctgatcacccatcagtgtcgtaaatgtcaggtcaatctcagatgcggaatcctcatcgatggttacccgcagcagcactcttttatccgggtccatagtagtatcccagagctgttctgcatccatctcacccagacctttatagcgctggatcttgttattattgtctcttccgatctcattgacaatattgttcaattcctgatcagagtaagcataccaaaactttttatttctctccacacggtaaagcggcggctgagccatatatacgtatccctccttgatcagatccggcatgaacctgtaaaagaacgtaaggagaagcgttgcaatatgggctccgtccacatcggcatctgtcataataataattttatgataccgtaatttctcaatatcaaaatcgtcatgaatgcctgtgccgaaggctgtgatcattgcctgaatttctttattcatcagaatcttatcgagtctggatttctctacgttaagaatttttcccctcagaggaaggattgcctgggttgcacgggatctggccgtctttgcggaacctcccgcagaatcaccctcgacgatataaatctcacagttttcaggattcttgtcagaacagtccgccagttttccgggcaggctgaacccgtccaaagcagtcttccttctggtaagatctcttgcttttctggcagcatctctggctctctgcgccaaaactgctttctcacatataatctttgcaactgccggattttgttccagaaaataggtaagctgctcattgacaatgctgttgactgctcctctggcttcgctgtttccaagcttttgttttgtctgtccctcaaactgaggctcgccaagtttaatgctgatgacggatgtaagtccctcacggatatcttctccggaaagattactctcattttccttcagcagcttattctttcttgcataatcattaaaggttgttgtcagcgcgtttttaaagccggacagatgggttcccccttccggcgtaataatattattgacaaagcttaaagagttttcgttataggagtcattgtgctgcatagcaacctccacataaaccccgtctttttctccctcacagtagattacctgatcatagagggcttcttttcctctgtttaaataagtgacaaactccttaatcccgccttcatagtggaatacttcttcgacaggttcttcctgacggtcatctctgagaataattctcaggtttttcgtcaaaaatgctgtctcacgcagacgctgtctcaacactttatattcaaatattgtttcttcgaagattgtatcatcgggcaggaagcttacttcggttccgtttaattcagtctctcccacaaccttcagaggataacatacttttcccttttcatatcgctgattatatattttcccatctgtatgaacattgacttccagccagttggacagagcatttactacggatgatcccacaccgtgaagtcctccggaaaccttatatcctccgcctccgaattttcctcctgcgtgaagaattgtaaatacgacttccacgctggatacgccctttttcttattcatccctaccggaatccctcttccgttgtcacgcaccgtaacagaattatctttgttcagtgtcacataaatcgtatcacagtaacctgccagtgattcatcgaccgcattgtccacaatttcatataccaaatgatgaagccctttggcggatgtacttccaatatacattccgggcctttttcgtacagcttccagtccctccaggatctgaatctgatccgcaccatattctccttttttctcagtgcccatacgttcctcctaattttctctgacaattttacctgatttgacctgaaacattttgtcaatctgcagatgactgttaataaattcttccagccctgtgcatgtgatcaaagtctgaatgtcttttatactgtccaaaagataattcttccggctgctgtccagttctgacagcacatcatccaggagcagaatcggtgtctctccggtctgtctttttactaactcaatctgagcaagtttcaatgaaagggctgctgtcctctgctgcccctgtgacccaaatttgcggatatcaattccatttaccaaaaattcaatatcatcgcggtgaggccctgcccctgtggaagcatattttaaatcaatctctctctttctctgtaaaacggtcagaaattcatcatagtttacactataatcatatttcaaaacaattttttctttttttcccgtcagattcttatggatctccctgatgatctcattgagatcctcaataaatttctgccggtaccggatgacctccgatccatatttgacaagctggagatcccaactgtctaatgtatccaaaagttcacgctggtaagctagctgctttagtaagttattcctctgtgccatcaccctgttatagctggaaagctgatgaaggtacattttttcaagctgtgaaagctcaatatctaaaaactttctccgctcagaaggcccgttttttataatactcagatcttccggcgaaaaaaatatgacagggacaaagccaagaagatcgctggatctcttgatgggaatccggtcaatggccgcaccctttgtcctgctctttttcagatgcatgtcaatctggtgcccaatgtcctgtttcatcagatgaatccttatatgggattcattttctccgaaacgtatgatctccttatccttgcttccgcggtgggacttggttgttgcccccagataaactgcctcaaggatattcgtcttcccctgcgcattatcaccgtacaagatattggtgccgctggagaactcaatgatcagacggtcataattccgatagttttttaactctaaagactgaatatacataaggcacccgattatttcacaatttttacagcctgtccgtcaaattcgatgacttctccgccgtacagcttttttccccttctcgtatcaatctctccatcgacactgaccagtccgtcctgaatgacgatctttgcctccacccctgaacttacaagaccggcagcctttaatgcctggccgagttttatatactcttcactcaatttaatctgctccatcaagatttcctttctagtgattgaaatttaccggaagtattaagtaaatataggattccgaatcatccttgataaagcagggcgccttcggattaacaaggtatatattgatttcctcatcatcaatgacacgcagtacatccatcaaaaattttggattaaatccaatcaggatatcccttccctctttctgaatcaggatgttttcctccattgatccgaagaaagatgaaatactcagctccagagaattatcagtgatattgataacgataggtttcttgtcagattctctgatcaaaagactggcacggtcaatacagtccaaaaattcctttttgttgatcgtgatcttcgtctcataatcactggacagcatctgacttatcttatagtattccccttccaaaagtcttgaaacaactctggtctgatcaaattcaaataagatatgcttattcgtcacgtaaattataacatctttttccgcatcacctgaaataatttttgtaatttcctgaagtgtctttcctggaacgacaactttaaaagaatcataactctcttttaattcaatgtttctgatggaaattctgtgtccgtccagcgatacaacatttaattttttgtcttcaacctcaaacagctcacctgtcatgagtttattattttcattgtcagaaatagaaaatattgtctgcctgataacttctttcagagtaaactgagacaaagtgatgcttttttctttttcaatctccggaagatatgggaattctgatccttcctgtcccacaatatgaaaacatgctttttcacaagtgatagttgctttgtaatcagaatctgtttcgatcgtaacatcattatccggcagttttctgacgatctcaaaaaataacttggcatccagagcgatttttccctgttctaaaatatttccttctatgtttgtctcgatgcccagttccatgtcatttgcagtcaatgtaattgtaccggcacttgcctccataagaatgcattcaagaataggaagtgttgtcttattggaaacggctttggatacaatgctgacaccggaaaccaggtcgcttttattacaaacgattttcatattgtgtataactcctttcaggttcaaaaatacttaaatatatattaaaaatccgcagtataagccgtaggggctgtggatttgtgaataaccctaaaaaacggcttaatttaaggctgaatcagggttaataacttgttaaaaagccacggataaagctttcataactcgaaggttatcaacaagcctgaaattaaggttttcattatcaacacaaaagacacaggttatccacaacattgtgtgtataagccttatgaagggttcatttttttaataataacgtcaagggtcgtggataaagaagaatctttctgtaaatccttctcaatcttctctgaaccatgaatgaccgtagagtggtctctttttccgagatactcacctatttttacaaaagaagtatccgtaagtttcttgcacaggtacatacagatctgccttggatatgcgatatcatggcttcgttttttggatataatatcagccggctggatgttaaaatgttcagccaccgtagtgatgatcagatctggtgtaatttttacaacagtatcattgtccacaaggtcttttagggcaattttagctaaatcaagatcaatcggtcttttttcgagtttggaatataccctgatcttgttcagtgctccttccagttctcgaatattcgatttaatgtttgaggctatgtagtcaaatatagcatcgtcgatataaatgtgatccagttcagcgcgttttcttaaaatcgcgattctcgtctcataatcaggaggctgaatatctgccgtcagcccgcagccaaaacgggtcctcaaacgttcttccaaagtctcgatttctttcggaggcttatcggaagatatgataatctggcttttggaattatacagagcattaaatgtatggaaaaactcctgctgggtgctgtctttacctattataaactgaatatcatcgatcaggagtacgtcgatggtcctgtatttgtttctgagctcttcctgtttgttgtgatggatcgcattgatgacttcgttggtgaaatcttcactggtcacatacaggaccttgagtttgctgttattttccataatgtaatgggcgattgagtgcatcagatgggttttccccaatccggcgccgccgtataaaaaaagcggattgtaagcttccgccggagcttctgccacagcaatgcaggcggcatgagccatctggttgtttgttccgacgacgaaactgtcgaacgtatatctcggatttaagttattggaatcctgaagctgggtatccgtgcgggatgcaggagcctttttcttcttagcttcttccagaacaaaagaaatttcgtattttttacctgtgatatcctgaatggccagagaaatataaaagtcatacatcttactttcaataaaatgtatgcctctggcatcaaaattactgttcaatgacaaaacaatctgatcgtctttcacttctttaatattgaggggtttaatccaggcgttgatggcagcacttgaaatatcgtgttcctgttcaagttttaacaaaacgtcatcccagatcgcttcgatttttttcttcattgatttttacggacctctttctaaataagtttaaaaaaatacactattactagtgtataacaaaagaatttttttttcaatgtttctttcatataataagtacaatcataatacaatatatgttgtctgtgaaaaactgtggataaatttattcacaaaataaacactaggaaatatcaggggtttcgacacatataaacatatgataaacaaatatttcacatagttttccacatgttatccacaaattgtgtataactttttagagtcctacaatatctatggatggaataactttatcgcaaaaaaacatagaattctcttgacttatgcaggtgattttgactataatgggagtgatgttttttagaaaatatatggtttcatatataaaattactattttttgattaaggaggtgtttctagacatgaaaatgacatttcagccaaagaaaagacagagatctaaagttcatggtttcagaaagagaatgagcactgctaacggaagaaaagttattaagagcagaagagcaaaaggaagaaatagattgtcagcataggtcgcagtgatgtgaccttttcttttctctaaataatagggaaggaaaagatatgaagcattatcattcattaagaacaactaaggaatttcagcaggtatataaaaccggtaaatcaaaagcaaacagatatttagttttatactgcagggaaaatcagcttaattataatcgttttggaatctctgtcagcaagaaggtgggaaacagtgtcgtgagacaccgggtgaccaggcttctgagggagagttaccgtcttcgtgagtcagagtttaagcagggatttgatcttgtagttattgccagaaatacggttaaggatgaaggttttcacacggtggaaagtgctttgctccatctgatgaagcttcatcgtttaaaaagagatgaaaaacattgaaaaagattttgatttatttgatacagttttatagagcacatttgtctaaattaaaaggaaaaggaacttgcatttatactccgacctgttcagagtatgcagttgaagcactggaaaaacacggcgcgctgaagggaagccttctggctgtgtttcgaatattgagatgtaacccttttgcaaagggaggatatgatcctgttccggaagtgagaaaggtgaaaggtaaaaagaaatgatgtatttggctcaagcagcccaggcaggcagcggtggattattgtctccgattgtatgggttttcggcgagatcatgaagtggatttacaatggattatcagctgtcggtattgagaatcttggattgtgtattattttgtttacattgatttcaaagttgattatttttccgctgacgatcaagcagcagagaagtatgaagatcaaccaggtggcacagcctgaaatgatgaagattcagaagaaataccgtggtaagagagatcaggcatctatgatgaaacagcaggaagagatgcagaaagtctatgacaagtatgggacaagccctaccggaggatgtgcgactacattgatccagtttccgatcatcatggctctgtattatgtagtcagaaatctggaaggttatattcctaacattcctaagagtgcgtatgaatttgttcttggaattaacattcagaatacaccgggattcaaactgagtatttatcttattatcccgcttttgtccgctttctttcaatatttaagtgcacgtacatctatggcagacatggattcagataatccggcggcaggtatgtctaagaatatgatgctgatgatgcctattatgtctttattcatgtgtatcactcttccggtgggaattggtatttactggactgcaagtgcagttttccagtgggtacagcagattttgatcaataattactataatcatacaaacatgcagaagatcattgagaagagcagagagaaagcagccaagaagaaagctaagaaaaagggtccttcaatgtatgaaaaaatgatgggtgctgcaaacggcagtacaccgtcagaatcatcccaggataatacgatcagcagcattgcaaagaaaaaagtcacaaaaaatgtagagtataacacagaatcccagggaggaattgcatctaaggcaaatatcgtgaagaaccggatggataaagggggaaaataaaatggcagtaacgcgttttactggcaaaacggaatctgatgcggttatgaatgcggccatggagctgggaattccgagcacagaaattcagtatgcagtgattgacaaagggagcaacggatttttaggactctttaaaaagccggtgatcattgaattgacggaagaagaaaaaccggctgagcctgtaatggaagataaacctgagaaaacagaggaggtgcaggctgctccagaaaagaaaaagaaacaggtccaggaacccaagaaggctgccagtgagaatccgaaagaaaaagtttataaacgcccggataatattgatcagatcatagacgacacagaagcatatctggatgaagtattaaaggcgatgggacttgttcctaaattaaatctttattataatacgaccggaaatgtgctgaatattaatgttaccggtgaaaagatgggcgctctgatcggaaagcacggacagacactggatgcactccaatatctcacgagcctgtttgtgaataaagaaagcgaagcttttattaaagtaaagcttgatacggagaattacagggagcgcagacaggaaactttagaaaagcttgcgctcagcattgcaaataaagtgaagaagacaaaaaaaccggttcatctggagcctatgaatccgaatgaacgccggattatccattctgcacttcagagagatcctaagatcgtgacaaaaagtcagggaaaagatccttaccgcagagtggttgtcatgctgaaaaaataatgaatttgggttgccttttgcggcagcccttttttgccttgcggaggacattgaaatgggaacagatacaatcgcagcgatagctacaccgctgtccagcagcgggattgggattataagaatcagcgggccggaagccatagatattgcttctgaagtattccgcccgaaaagagaaaaagatataaaaaaggcagccacttatacggctcattacggacatgcagtgaaggacggaaaggatattgatgaatgtattcttctgattatgaaaggtcctcattcctatactgccgaagacgtggcggagatcaactgtcacggcggagtcgtcgtgatgaaaaaaatactgtcttgtatcattgaagccggggcgaggccggcagaaccgggtgaatttacaaaacgggcatttttaaacgggaggattgatctttccagagcagaggccgtaatggatctgattcactccaaaaatgaatttgccatggaaacatccttaaagcagttaaaaggaagtctttctgaaaaaattcgttctttgagaaaagagattgttcatagtgtggcgtttattgaatccgcattggatgaccctgagcattattctgtagacggattctctgaacagctgaaagtacaggtagagcacgccagggatgacattcagaagtatcttgattcatccgacaacgggcgtatattgaaagaaggtattcacacggcgattgtgggaaaacccaatgccgggaagtcttcgatattaaatgtcctgctgggtgaagaaagagctattgtcacagatatcgcaggaactacaagggatactctggaagagtcgattcagatcaacgggattccgctgaatgtgatcgatacggcgggtattcgggatacggatgatgttgttgagaagatcggtgtggataaagcgagagattcggtgataaaagcggatctcgtcctctatgttgtggatacttcggttccgctgacaaaagaagacgaggaaattatgaagcttcttaacggaaagcaggtaattgtactgttaaataaatcagatctggaaacaaaagtttctgaaagtgagtttcttgacagaggattccaaaatatcgttccagtatcggcgaaaagtctttacggactggaagatctttatgagaggatcaatgatcttttctttaacggaagggtatcgtttaacgacgaagtatacattacaaatatgagacataagaaagcgctggcaaatgcaaaggacagccttgatctggttctgaaaagcatcgaggaccggatgccggaggatttcttttcgattgatctcatggatgcctatgaggaacttggctatattattggggagtctgtgggcgaggatctggtaaatgaaatatttgcagaattttgtatgggtaaatagagatgaaaaatttagaagaattttatgatattgtagttgtaggtgcgggccacgcaggctgtgaggcagcattggcctcagcgcgccttggatttaaaacaatttgttttacagtgagcatggacagtatagccctgatgccgtgtaatccgaatataggaggaagctccaagggacatctggtaaaagagatcgatgctcttggcggtgaaatgggtgtgaatatagataagacttatattcagtccaaaatgctgaaccgttccaagggaccagctgttcattcactcagggcacaggcggataaaaagatgtattccatggctatgacacagacaatgggaaatacaaaaaatcttacggtcaggcagggagaagtgacacagattctgacacagaacggcaaagtcacgggagtaaaaacttactcgggtgccgtttatcatgcgaaagcagtgatcctcacaaccggtacttacctgaaagccaggtgtatttacggagatgtgagcaatgagactgggcctaacggtcttcaggcagccaattatctgacacagtctctgaaggatcttggaattgaaatgcgccggtttaagactggaactccggccagaattgataagaacagcattgattttaataagatggaagaacagttcggggatgataaaattgttccgttcagttttacaaatactagagaagatatacagagagatcagatttcctgctggctgacttacacaaatgaggagacgcatgagatcatccgtgaaaatattgggcgttccccattattttcaggtgccattgagggtacaggcccccggtattgcccctctattgaagataagatcgtaaaatttccggataaaaaccggcatcaggtttttattgaacctgagggtgaatatacgaatgagatgtatgtggggggaatgtcaagttctctgcctgaagacgtccagtatgccatgtaccgcagtgtgacggggcttgaaaatgttaaaatcatcagaaatgcatatgctattgaatatgactgcatcaatgcaacacagctgaagccttctctggaatttaggaaaataggagggctgttttcagcaggacagttcaacggaagttccggatatgaagaggcagctgcccagggactgatcgcaggcataaatgctgcgagaatgatccagggaaaggaatctctggtccttgaccgctcccaggcttatataggtgttctgatcgatgatcttgtaacaaaggagacgagtgagccgtaccgtatgatgacttccagggcagaatacaggcttttgctgagacaggataatgcggatctccgtctttcgaaaataggatatgaaatggggctaatcagtgaagagagatatcaaaacctgctggagaaagaagcgcggatagaaaaagaaatcaatcggctcagccgcgtaaatgtcggggcttcaggaaaggttcaggatctgctttcaaaatgtcagagcacggagttaaagtcttctgcgactatggcagaactgatcaggaggccggagctcacttatgatatgctttctcccattgatccggacaggcccgaatatcctgaggatgtgagagaacaggtgaatattaatattaagtatgaaggttatatcaaacgccagctttctcaggtgagacagtttaaacgcttagagaagaagaaaatccctgagggaataaagtatgaagatataggtaacttaaggattgaagcaatacagaagctgtctaagatacgtcctgcatcgattggacaggcgtccaggatttccggggtatccccggcagatatttcggttcttctcatttatttggaacagcttcatcaaggggcttaggagtgtatatgattagtttaagagaaaaagcagaagagttaggaattgcattgacagacaggcagcttgctcagtttgaaatatattatgaattactgacagagaaaaataaggtaatgaatcttactgcgatcactgagagagaggatgtgatcctcaaacattttgtggatagtctggcattggtgaaggcggagtgtggattttcttcacaaaaaattctcgatgtggggacaggagcgggatttccgggaattcctttaaagattgcatttcctggattaaagatcgtacttctggactccctgaataagagagttaaatttttgcaggaagtgatcgatgctctggaactgcatgatattacggcagtccatggaagggcggaggactacgccaggcagaaggaataccgtgagcagtttgacctggttgtctccagggcagttgccaacttgagcacgctttcggagtattgtcttccctatgtaaaggtatcaggaatgtttcttccttataaatccggcaggatcgaagaagaaatgagagaaggaaagcatgcggtacatctccttggtggagagattgaagatgttgtgtcatttgtacttccgggtacagacatggagaggactattcttaaaataaaaaaacaaaaggcagccccgaagcgctatccgcgcaaagcagggctgccgtcaaaagagccgatccgttaaaaaaagattttgcaggctttcaggacttcatcgggattttccagatgaggcaggagttttgaccctttaataaaatgatattcaacggaaggattcaatacctggtactgttcaatggtgttttcggcctctggcgtatgatctcccatgaggaagtaaatactgtggtttaaattttttatggatggaatcagattacaattcaggtagtctgagatgaggcttgcatacaaatattttgtgtctgatccacatttgtgagcggattcatgacagatatccacatatttctgcttaatgtccttaggtctgtggaaatattcccgggcaagttttttctggatcattggtctgctgtgcaggatattgtaagtgagtgtgccgatgatcggaagctccataaaatatttgagtacttttttgcggttcccgggataacgccctgcttttgtcatattttcaggattgatcatcatgagccggctgaaattcctgggttctgtgtagcatgccagaaagatcagagatgatgactttccgctggcgatgatgtcagtctttgtgccgattacatttttgataaaatcattgatcagctgaacataaagatagcttgtataagtgatccgcggtttgtcggaacggccgcatcccagaagatccaaagtatagaccgtatgtgacctggagagttcttcttttattttataaaattccagttctgagctgcagttgttcagatcgtgaatgaggagaagcggagaaccggttccatgttttgtatagtagagactgccgaatctccaggagtaagtattgccgtatttggagaacagagcatccttcatggaggatagtgagaagacaagcttatttatcagatatacacatattgttgaaacagttgtaatggtggccagatttcgcagttttttatagaaacgcatacagagtctcctttctaatttattactattattatatgacaaacaaggatttgatacaataatactttgcattccttagaaattcgtttatcatagagaaaagaggtggtgagatatttggatgagaagaagattgataaggatcagctgatgtcagatctggcagcctatttatctgaagaatatatggagtgtgtggctgaaaaagaaaaatttatagaagaaaaatataaactggaagaagaaaaagagcggctgatccgttgtgtgatgctggaaaaagaaaagagacagattcggtcagtattttctcctttgtccttagatgaaaacctcatggaagaagtgaaggaaccggatacaagagaagtggaacatgcattggatgtgttatccaaaaatatacggaagatacaaaaaaagtgtgataggctgaaatcatatttaaaaggactggaagaaacttattttgtggtttctggtttagaggagctggataagagtcaagaggaggttctgtttcttcctgcattttatgaacttatggatcatttcagaaaaattcatcctgagattacagtcagctttgagagaatagaaaaagaatcaccggtgattcttacattttcattcttgacaggatttcatcagatgatgagatattctgttcaaaaaataggaatttgttctttaaatatagatacctttattgaacatgacagaattatgctgcagtttgttatgaaaccaaaaaaacaggcatccattcaaaaatttaaaaaaaatagaaatatattggaagacatattgaccagagaatttgcaattaccagatggcaggaaaattcagtggtattgcaggcaatcatagaagcataagtgaggagaaagatgagaaataaaataattgatttaattacagattctattaaggaattggacagagagacagtgagccgtattttagaaatacctcctcaggaggatatgggtgatttcgcatttccatgttttcagctgtctaagattttccgaaaagctccgaatataatagcacaggaggtagcagaaaagataaagaaaacagattttgtctctaagacggcagctatggggccttatgtaaatttctttattgacagaacaatgtttgtaagtgaaatgttaaaacaggtttctgtggataactatggaagttctgagattggatgtggaaaaactatctgtatcgattattcttctccgaatgtggcaaagaattttcatgtcggtcatctgaggaccacactgattggaaattctatttaccgtatttataaaaagcttggttatcgggtagagagaatcaatcatttgggtgactggggcactcagtttggaaaattaatcgttgcctataaaaaatggggaagcaaagaggctgtggaacaaaacggtatatctgaactgatgaagatttatgtaaaatttcatgaagaagcagaaaaggacgatactttaaatgatgaggcccgggcatggtttgtgaagatggagcagggtgatgaagaggctctttctatctgggagtggtttaaagatataagtttaattgaatataaaagaatttatgaacttttggatgtagattttgactcttatgccggtgaaagcttttacagggacaagacttctgccgttgtggatgagttaaagaaaaaaggaatgctgaaagaaagtgaaggcgcctttatcgttgatctggagaaatatgatatgactccttgtctgattatgaaaaaggatggaagttctatttatgctaccagggatcttgccgctattttttatcggaaaaaaacatatgattttgaaaaatgtatctatgtcaccggtatggaacagaaacttcactttgcacaggtgttcaaggtggtggaacttatgggatatgagtgggccaaaacagatttgattcatgtaccttatgggttggttagtctggaaggcggaaaactttctaccagaagcggcaatattatttatgcagaagatattctccgtgaatctgtatcaaaaatcaaagaggtcatcaatgataaaaacccggatttacaggataaagaagaagttgcaaagatggtaggtattggtgccattattttcaatgatctttataatcagagaataaaggatgtcacattcagctgggataagattcatagctttgatggtgagacgggcccttatgttcagtacacttatgcacgtgctgccagtgttttgagaaagactggaataacagatgtgcctgaagaaatagattcttctttattgacagatgaagcatcggtttccttattaaaagaattgatccgttttccagaagttgtagagacagcagcagaacgtctggaaccttcggttgttgcaagatttgttatgtctgtcgcccaggcatttaatcatttttatcatgaaaatcagtgtaatgtggaagatgaaaaacttaaaagggcaagggttaagttagtaataattgcaaagaaagcaatcaaagacggcctcgatcttcttggaatgaagtgtccggaacagatgtagtaagaatataaagttggctaaagcagatatgaaatttcatatctgctttgtttttatgtttcacgtgaaacattattgtatttattttcatgtttcacgtgaaacatctggaaatgaaaagttgtaagtgatataatatttcttaaaaggagattatataatatgggaagaattatcgcaattgctaaccaaaagggcggcgtcggtaaaacaacgacggcggtgaatctttctgctgccctggctgctgcaggaaaaaagacacttatcatagatatggaccctcagggaaatacaacaactggtctgggattggacaaaaatgaattagaacatacggtttatgaagtgatttcatctgaaattacatttgatgaatgtatttgtccggaagttattgaaaacttatctttggccccagctaaccgtaatctggccggagcagaaatagaattgatgacagtagaccgcatgcagtacatactaaaagagaaacttcagccgactgtcgaaaactttgagtttattatcatagactgtccgcctgccctgggaatgctcacagtcaacgctatgacggctgcagataccgtaattgtaccaattcaatgtgaattttacgcactggatggattgacacagttaatgtatacgattgagttgatacagaagagtcttaatcctgacttgaaaattgaaggtgcagtgtttactatgtatgatgccagaacaaatttatcgctgcaagttgtagaaaatgtaaaatcatatttgaaccaaaatatttataagacaattattccgagaaacgtgcgtttggcagaggcaccgagccatggacttccgattaatttgtatgatcctaagtcagttggtgcagagagctatcaaatgctcgcagaagaagtcattgcaaacggaggaaaagaggaatgacgacgaaaaagaaaacaggattaggacggggactgaacacattgataccaagtgctccggttaaggacaccgaatcagaaaagattttaaaaaaagaagagcaaataaaatcggagattgtggtaccgatattgaaagtagaaccaaatccgaatcagcccagaagacagttcgatgaagattctcttcaagagctggcggattcggtcaagcagtatggaattcttcagccgctgattgtaaaaaaacatgataaattttatgagatcatcgcgggagagcgcagatggagagcagctaaattagcgggcttaaaagaagtgccggtgctgattagagattatgcagaaaatgaaatagtagaaattgcattgatcgaaaatattcaaagagaagatttaaatcccattgaagaagcactggcttacaaaaggcttatggaggaattttcactgaagcaggaccaggtggcggcaaaagtttcgaagagccgtgctgccatcacgaattcactgagacttttgaaactggatcagagggtccaaaatttgttgtcggaagaaatgatcactacggggcatgcccgtgcacttctggcgattgaagatcccgatcagcaatatgagactgcgatgaaagttttcgatgagaaactcagtgtcagagaaattgagaagcttgtaaaacagatgtcaaagaaaaagaaggaaactccgaaagaggagaataaagttcaggaatttctgtttgccaatatagaagaatccttgaaacaggcactcggcagcaaagtgaatataaagaatcgaaataacaaaggaaagattgagatagagtactactcaaaagaagagctggatcgtttagttgatatgctgagaacgttataggaggaatgaaatgacaacaggtattacaatttttggaattgacttattttatgttttatgcggcttagccggtgtatgtaccctggcactgcttttaattgtagtattgctggtgaagaccagcaggttaaaaaagaagtaccgcatgtttatgaagggggaaaatggaaagtcccttgaaaagacttttgtaaaacattttgatgaattggaaagaattgaagaaaatcataaaatacttgatgaagaaatgggaagactgaaagataagcttcaattatcatattccaaaatgcaggttttaaaatataatgcatttaaagaaatgggcggagagacgagttttgcgattgcacttttggatcacaggaacaatggaattgtattgaatgccatgagcaaccgttatggaagttatatgtatgcaaaagaaattaaagatggccgttcagaggtagcactttctaaagaagagcagattgtgttggaagattgtatgaataaataaacatatcaggaggaaatcatgttagacattaaatttgtgagagaaaacccggaagcagtaaaacagaacattaaaaataagttccaggaccgcaaactgccgctggtagatgaagtcttagaattagatgaaaaaaacagagagatcaaacaggaagttcagtctctgagagccaataggaataagatttccaaacaaattggcggattgatggcacagggaaaaaaggaagaagccgagcagctgaaacaggaagtgtcaaaccaggccggcaggattgaggaactgacagaggaagaaaaagaagtagaagaaaaaatcttaaaaatcatgatgaccattccgaatatcattgatccgtcagtgccgatcggaaaagatgacagtgaaaatgtagagatcgagaaattcggtgaaccgattgtccctgactttgagattccttatcacacggaaattatggaaaacttcagcggtattgatctggacagtgcaagaaaagtggcaggccagggattttattatttgatgggagatattgcgaggcttcattcggcagtcatctcttatgcccgcgattttatgatcaacagaggatttacttactgtgtgccgccgtttatgatcagaagtaatgttgtgaccggcgtcatgagttttgacgaaatggatgccatgatgtataagatagaaggggaagatctctatttgatcggaacgagtgaacactctatgatcggtaaatttatcgatacgatgattcaggaagaagaacttccgaagaccctgacaagctattccccatgtttccgaaaggaaaaaggagctcatggactggaggagaggggagtttacagaatccatcaatttgaaaaacaggaaatgatcgttgtatgtaaaccgcaagaaagtatggactggtatgaaaaactgtggaaaaataccgtagatctgttccgttctctggatattccggtccggacattggagtgctgttccggagacctggctgatctcaaagtaaaatcagtagatgtagaggcatggtctccgcgtcagaaaaaatactttgaggtaggaagctgttctaatcttggagatgcacaggcacggagattaaagatccgtgtgaatggagaagacggcaagtactacgcccatacattgaacaacacggtcgttgcaccgcctcgaatgctgatcgcatttttggaaaataatcttcaggcagacggcagtgtaaagataccggaggcacttcagccttatatgggcggaatgaacgtcattcagtaaaggattttatatggaaaaagcaaagattattttagtggaagataatcagaagattcagaaagaactctgtgagtttctgagcagatatgattatgagacaaaagcactcaataactttgaaaatatagtggaggatatcctgaaggaaagggctgatctggtccttctggacatcaaccttcccgtgtacgacggatattatatatgccgtgcggtcagagaaaaatcggatgtcccgatcatcgtcgtcacaagcagagacagcgagatggatgagctgatgagcatgaatctgggagccgatgattttatttctaagccgtataacacacagattcttgtggcacggatatcttctctgctcaagcgtacaaaacatgtgaaagaagactggcagatgactcataagggacttttgatcaatctgtcaaacagtacggcatgccacggagaagagcagatagaactgagcaaaaatgaagtgaagattctgtctgtgcttgtgaagcataaagaggagatcgtttccagagataatctgatggaagaactgtggcagtccaatgaatttgtagatgacaatacactgacggtaaatatcaacaggctcagaaaaaaactggattccatcgggcttgccgattatattgtcacaaagagagggcaggggtatcttgtatgagcttcagggcatatttaagagataagtcattattttttggacttcagatattttatctggcttttctcgtatggatgctgaatctgttccacgccacaacctttgctattatatatctgctgtgtctgtactttattcttatgattcttgcactgggaaatgaatattttaagagaaaacgtttttatgagacggcgctggaaagtatggattccttagataaaaaatttatgctcccggagcttcttgacaggcctgattttacagagggaaaaatattttatgactgtctgtcacagactaataagtctatgagcgatgaagtggcagagtataagatctctgcccaggattacagagagtatgtagaaatgtggattcacgaggtgaagacgcccattgccgcttccaggctcatgatagaaaataatccgtctgaggtgacaaaaaatatcagcgaagaactggaagaagtggaatactatcttgagcaggcgctgtattattccagaagcaacggagtagagaaggactatattgtaaaacgtatgaatctgaattccatggttcaggaactgatccgcagcaattccaagattttgatccagtcgaaggtaaaggtaagccttgaaaatctggattatgatgtttatacggatgaaaaatggatgtcatttattctaaagcaggtattgatcaatgcagtaaagtaccgcaaagatcatcctgaaatccggtttacagcagcagatgaaaaggaacaggtacagctttttatagaggataacggcatcggaatatcaggaaaagatcttccaagagttatggaaaagggttatacggggactacaggaaggaagtatgccaaatccacgggaatgggattgtatctttgcagaaagctctcagataagcttggaattggatttgctgtccggtcaaaagaaggagaaggcacacagattaaaatcacatttccaaaaaattcatttgtgtatatgtagataaaaaccgctggacataagaatgtcagcggttttgtgttattttggatcatgttcatctgcatttgggcagtctttgatatttattaccggaggacggaagggatataactcctcataggattccatcgctgcctcagactctggattggcaggaattagtccggtacagtcagtcgtggaacaggtagaacacatatcaaaaatgttttcatcgatttcttcattggtcagttcttttttctttttcatgatatcaacctccttgttgagatacaattagtatggttggtccatgaaaaaaatatcattcaagaagatttttctaaaattttatttgtctaataatattaaggcgatgatttccaggtctgtgtcaccgatattttcaatgccgtgaccgcatccgctcatagtatatgtagtatcccctgcattcacttcatattcggtaccattgtcattgtacatgccttttccggctaaaatatgataggcttctccttccttttcgtggacatgatagccgaaggagcatcccggcgggatgatgattttgccgaacagacggctgctttctttcatctcttcctttgtcagaaaagaagtcttccggatcgttcctttgcctccccgtgcattttctacactctcaaactttacatcttcattttttaaatacatagctttacctccatttttcttggttatagtatcagtatagaggatagctttttaaattacaatccaaatagaaagtgacaaaagtgtaagtttgctgtaagacagttcgatggatagagtaaacagacagtgatatagtaaggataacataaagaaagcaaaggagaattgggatatgaaaacagtattgcaagttcaaaatatggaaaaatattatggaaacaaaggaaatgtgacaaaggctgtggacggcatcagctttgacgtggaaaagggtgaatacatcggtattatgggagcgtccggaagcggaaaaactacgctgcttaactgtatttccacgattgaccgtgtgacctcgggccacatctttatagacggaatggatgtgacaaaactaaaagggaaacatctttccaagttccggagggaacagctgggatttatctttcaggatttcaacctgctggatacactgactgcctatgaaaatatagcgctggctctgaccattatgaaaactccggcaaaggaaattgatgaaagggtaaaatcaatcgcggaaaaattaatgataacaaaagaactgtccaagtatccgtatcagctttccggaggacagaagcagagagtggcaagcgcaagggctatggtaaccgacccgtccctgatcctggccgatgagccaaccggagcactggacagcaagtctgcaagaatgcttttagacagtatggaaactatgaacgcggaactgcatgccacgattcttatggtgactcacgatgcgtttacggcaagctactgtaagcggattctgtttatcaaagacggtaagatttttaatgaacttgtgagaggcagggattccagaaaagagttttttgaccgcatcattgaagtggtgacattgcttggaggtgacagtacaaatgtattctaaattagcgtttggaaatgtaaaaaagagcataaaagattttacggtatattttttgacgctgacattcggtgtctgcctgttttatgtatttaactctatcggcagtcaggaagcgatgcttaaaattaatgagtcacagaaaagtatcattgaaatgcttcagatggcaatcagttcgttgtctgtgtttattgcagtaattcttgggtttcttgtgatctatgccaacaggtttttgatcaaaaggcggaagaaagagcttggactttacctgtgcctgggaatggataaacggcaggtttctaaagtactgatcatcgaaaccttgtttattggggtgtttgcactggcagcaggacttctggccggagtatttttatctcaggggctgtctgcggtaactgcaaaaatgtttatggtagagatgaaggaatttacttttgtattttccggagaagcatttataaagacgatcatttactttgcggttattttcctgattgttatgatctttaatacgttcagtatatccaaggtaaaggtcattgaccttttaacagcaaataaaaagaatgaagatttaaaagtaaaaaaactgggagtttctgttgtattgtttttgatttctgtattatgtattggagtagcttattactttattcaggaaaacggtatgatggaagtagatggtcaattttggatgagtattatctttggtacgatcggaacatttttgtttttcctgtctctttccggattctttttaagaattttgaagacgaacaagaagttttattaccgaaagcttaatatgtttattttaagacagatcaattcaaagattactacaacctttgtatccatgacactgctctgtttgatgctcttagtggcaatcggtgtattttctactggagccggactggcaacgacaatgggcggagatatgaagaaggcgacaccatatgatgtatcttatgttaagtatttcccggaagaagagaagaactttaaagtaaagacagacatgagaaaagagtttgagtcaaaaggaatcgatatgaacaaatttgttgataaatcatgtatgatttccacaaggctcaatgcaaaacttaaattcaagatattcttaaacggccgtgataaacttgtagattatcctaaaggtgtaaaagaatcaatggaaaagtcatcgcctgaaattataggtttatcagactacaacgaagccatgagaaagcagggaaaacagacgatcagtctgaagtcggatgaatatgcagtaaactgtaattttgacaatatgaagaagctgtggaaagacgtatgtaaagacagggtagagatcaaaatggacggcagggctctgactgcaaagagttctatgatcgacagtacctattattctgcgtcttctctgccaatggacatgggaactttgatcgttcctgacgatgttgcagaaaagttttctgtgcatacagttgtgtataactgtcagttaaaagatgatgtagaagaaaatacccataaactaagtaaactgatggaaagtgtgtatccgaacaaaacaatggaggaaagaaataaagcgccgtatcacacagcgatctatagggtagaaatgatcgaacagagcgcgggactgagcactgtgattacctacattgctatttatataggagcagtcttcctgattacatgtgcagccgttctggcactgcagcagctcagtgaaaattcagataacgtggaaagatataatctgctgagaaaaataggagcggatgagcgaatgatcaatcacgctatgctggcacagattgttatttattttatggttccgctgagcctcgctctggtgcactcctatatcggtgtgaaggttgccagtaacgtgatcgcaacattgggaaatgtaaatgcactcaacggcatcctggcttcgggaggcgctatcctcgtgatttatgggggatatatgttggcaacatatcttggaagcaaggctgtcatcaaggataaaaacagataatcagatgataaaaccatataaaaaacagcagattttcgaatatctgctgttttttatttcttaaaaggatcttgtcatgcaggtttttaaggaattttaatgattgaaaatgcatgatattgattgactttgaatgaaatggtgttataataaaagaaaaagaggtgattttatgctgccggatgaacggtttcggaggattttagagataatacggaaaaaacagtctgtcacagtgcaggaactggtaaaacagatcgggatatctgagtcaacagtccgcagagacctggcggctctggacaaaaaaggtctgctgcataaagttcacggaggagccacttctattgatgcgggatttggtgcagaagaaacagtcgcgaagaaatctctgaaaaatgtggatgaaaaacgccggatcgcacaatactgtgcagagatcatcaggccggacgattttatttatctggatgccggaacgaccacagagatgatgattgattttctgacagagaaaaaagcttcttatgtcaccaatggaatcatgcatgcaaaaaaactcatggattatggttttagggtatatttgatcggaggagaactgcgtgcggtaactgaggcggtagtcggggaggaagccctggaaagtctcagaaagtataactttacaaaaggattttttgggatcaacgggatttcgaaaaaaagcggttttacaacaccggatgtaaacgaagcactggtaaagaagacagctcttagtcaatgtctggatgcttatatcttagccgatgcatctaaattcggcaggatttcagcagtctgcgtggccgggctggatcaggcagtcatagttacagggaaacttaaggaaccaagctttttaaaatatacagcgattaaggaggtatcagaatgatttacacagtaacatttaatccggcgattgattacgtcatcaaggtggatgacctgactcttgggaaggtaaatcggaccaaaagggaagatatgtactgcggcggcaaggggattaatgtatcgaatgtacttgccaatttggggatcgacagtgtgggatttggatttattgcaggttttacgggagatgctattgagacaggggcaaaacagctgggatttaagccggactttatccgtctcagagaaggcatgacaagaatcaatgtcaagatcaagtcaaatgaagagagcgaaatcaacggacagggaccggatatccatgaggatgaactggaaatgatgtatcagaagctggatacattaaaagacggagatatattggtcctggccggaagtattccgaacactctccctgaagatgtatatgaaaaaattatggaaaggcttcaggatcgaaagattcagatcgtcgtggatgctacgaaagatttgttattaaacgttctgaagtatcatccgttccttatcaagccgaacaatcatgaattgggagaaatgtttggggttgaactgaaaaataatgaagaaatcattgagtatggaaagaagcttcaggaaaaaggtgcaaggaatgttctcatttccatggcaggagatggagcaatcctgatcacagaggaaggggatgtacacatttctccttgtccaaaaggtgaagttaaaaactctgtgggagcaggcgattctatggtcgcaggtttcctgaccggatatctcaaagctggagactataaggaagcattaaagatgggaattgccacgggaagcgccagtgcattttctgaggatcttgcaacgaaagataagattatggaattgtatgagcagctttagaataatttaattgtcaagtaggaaaaaagagaagtttttatggcttctcttttttttgcacttatttgtgaaaagaaatgtaacggtgacatttcttttcacaaaagatgaaaaacctcaaactgttttttacagagtgcggatgatatactcaaaccatagatgaggtgataaatatgaacaagagatctcgggaaatcttatctactctgattcagaaaaaagaatatgggcaggcggcacaaatgaaggagcttgcagagcagttcggagtttccgtaaggaccatccggaatgacttggagcagattaatgaatttctcagcaaaaatgaattgtccggcgtgagtctcggaaaacaaggcgtcattgagacgggaaaagatataaatatggcaaggcagtatcttttccgggataatttttattcctataagctggagaaaaacgagagaaagatatttatggcgacattgctgatctgtgaaaatgattaccggaccctttcggatctggcggactgcatgtatgtgagccggtccacagtgattcaggatttggaaagccttaaaaagtttttcaggaagcacagactttatgttgtctcccattccaataaaggattgatgttagaaggtgaggaaaaaaacaagagattattgttattctccatggtaaaaagcagtgaatccgtataccgggaggcaccggtttttgagagactgatcggttctctgaaagaggagtgccgggtagatatggaagatctgaagactatggaaaaggttatcaatctggcggaacatttttcgggaaggtttctcacagacacttccttcactgaccttaaatattttcttctcttaagcctgtaccgcatgcggcttaaaatttatgcagagcaggacggcaagaaaaacagcaaatatgaaatggcggggtatatattaaagcagctcagtgactttgctggcattgaggttgtggaggacgaagttaaatttctcggcagaatattaaatgagatgcgttatatcaaaaagacgaccagcaaccaggaaattgttaagatgcaggtgatcacaagaacctttattgagcatgtttctattgacatcgatttgaatttgcagggagattatatcttctatgaaaatctcattaatcatctggaatccatgttttcatcagccatacgggacaacacggtgagttcagtggtgacagaagtcctggagcgctatccgaagatacagaaagcggtacaaaacaatgtatttgtcctggaagattacatagggcggaagctgaatgaggtagaaatctcatatattgtggtgcatatctgtgccgcaattgaaagaaacagaaactccgcggagcgttattcggtaattctggtatgcaacggaggaatcggaacatcccagcttcttctggccaggcttaaaaagtatttcaattttcatgtagcagatatcataccggctcatgaccttaagaatgtggctgttgacgaggctgatgtgattctctctacagtagctctggacaccgatttagagtatatccaggtggatcctctgctgaatgacggagactgcatcaatgtagggaaaaaactttcgaggctgaaaggaaaccggagcaccggtaaaaaacagacgaagaaagaaaagcctgaggcagttcatatgaagcggatcaaggaaatccttacttcggatacggacccggaaaaaatgatatttaaaatagaagaggtcgtcaatgagttctttcacaaagaggtgagcctgcctctggctgaaatgcttccaaagcaggccataaggctgaatgtgagctgtaaaacctggcaggaagccgtcagacaatcggctcagtatctgcttgaaaatgattgtatcgaggaaagatatataagttccatgataaagaatgtggagcagaacggcccttatattctcgtggcaccggggttcgcactgccccatgaagctttaaatgccggtgcaaaaaaggtgggtatgagcctgatcagactggatgagccggtagtattcggtaaaccggagtttgatcctgtggagtgggtctgctgtttaagcgcaattaacaaagaaacacatttaaaggctatgttccatctcgtgaatctgtttcacaatgagaagtttcgaaataaaatacggccggcccaaagcagagatgaagtctataacgcaatcaaacgatatgaatatgaaatgaggtaatgcagcatgatttgggaagatttaaaagaggaactggtgcttacggatctcgatgccgaaagctccggggaagtctttgagcgtctgggaaagacactgatagaggaaggttactgcagggattcctatattgacgccttaaagacaagggaaaaggattttcctacaggggtcaacatgggaggagtaggaatagccattccgcatacagataaaagccatgtgtacaaaggcgcggtagccatcggaatcttaaaaaaacctgtgaagttttatcagatggggacaacagatgaagtggtcatggcaagactggtatttatgcttgccgtggacgatccggaagaacatctggtatttttacaaaggattctgcaggtgctgcaggattcaaacacactgaaacaattgacggagtgtacgaaaaaacaggacgtcatccacattataaaagaaaaagaacagtcactttcctgaacaggaaaaatgaaaggagatttattatgtcagcagtcaatattttatccgtttgcgggtctggaaccgtaacatcatctatggtagcggcaaaattgaaggaaaaattaggagaacggggatattctgtctccactacggaagccagaccgacagaggcattaaatcttgcccagtcagggagatttgatattcttgcacataccagcccgctcccggacggggattacggcattccgatggttaatgcttttgcgtgcattacaggtatgggagaagatgaattttttaatcagattgtggaagcactgaggtctgtcggaaaataaagagagagtaaaacggaggaaatacatatggaagcaattcttgcaacactgaaagcaatcatcgacaacttcggatcggcaatcatcgtaccatttattattttcattatagcattgatttttaaagtcaaagtacagaaagcatttttatcagcgctttatgcaggagtatccctgatgggatttactctgattctcggagcgtttacaccgatcatcacaccgatggtcaagaatatgtcccaggtcatggcaggcgtcacaggggtaaatttaaatacgtttgacgtgggatggcaggcgacctccgtcgttgcctttgcaaccagcgcgggaatgatctatctgggtctggggattcttttacagacgatcctgttccttgtaaaatggacgaatatttttcagccgtcggatctctggaataactattcctatattgtctggggcgccatggttattttcaagacccacaattttattttgggaatcgcatgtatgattcttttgaatctgtacagtctgctcatatcagagctggttgcaaagaggtggtctaaatactataactatcccaactgtaccattattgccatgcacaatgtagaacccgcgatttttgcaattttgtttgatccgatcttaaataagcttggattcaacaaattaaaactgaatccaaaatcgatagaaaagaaaatcggatttctcggggagcccatgactcttggatttttcctcggaatgtttatcgggatactgggaagcatcaataaacttggaaccatcgccggatggggtgatattttagaagctgcgatagctaccagtgcggtcatggcgatctttcctaaaatagcaagtatgtttgcccaggcgtttgcgccgatcacggaggccgcaagaaaattcatgggcaaagcaggtgacagggaatggtatattgccgtcaacgatgcggtcggctatggagaacctgctactcttacaagcggacttctgctgatccctattatgatcgtggtttctacgatcctcccgggcaatcaggtgctgccggtagtagatcttctggctatcccatatatggtacagggcctggtagcggtctataaaggaaatatgtcaaagattcttgtagccggaacaatttggttcagcttagggcttctcatgtgtacttatacagctccgctgtttacgcaggtggcaatctccgcgggatttgcgatcccggcgggagcagccatgattacgagctttaatattcttggaaaaccaatgcttgggttcgtattccttgcattcctttccggaaatcctgtcttcatcgcgattgcagtgattgtctacgcagtcatgtttgcagtctttaaactgaagaacaaggagatcgtagcttacttagaccgtcaggcggaaaaaaatgaatcagcggaagaagcaggggtgtaaagtatgaaggtagatgtgaataaatttttaaagccgtgcagctgcggcagaaaacatgaaatcattgtggacgatataattatagaaagcggggcagtcagcagactccccgagatccttgcaagggacgcatataagaagtttcaaaatattgtaatgatctgtgatgaaaatacttatgaggcagcgggaaagacggtggaacgccttgtgccgggtctgaaaaaggcagtccttgatccggaaaacctccatgccaatgaacatggcgtggaggcggcacaaaagtatcttgaccagatgggcgagctggatctgatgatcgctgttgggtccgggaccatccatgacatctcaaggtatcacgcctacgagaaaaaaattcctttcttctccgtaccgacggcggccagtgtggacggttttgtatccacagtagcagctatgacatggcacggatttaaaaagagctttactgccgtatcgccgatcgttgtcattgcggacacggatattttcagcagggcaccgatgcggctgacggcttccggtgctgcagatttgctcgggaaatatacggctcttgcagactggaagatcacacatatcctgatgggagaatatatttgtgaagaaatctgtgagatggagtatcaggcactggatgcgctgaaggccagtcttccgggactggcagccggcgatgcgaaggcttatgaagagctgatgtatggactcctgctttccggtcttgccatgcagatgaccggcaactcaagacccgcatctggggcggagcatcatatgtcccatttgtgggaaatggaagtgctgaatgattacattgacttttaccacggggaaaaggttggcgtagggctgatcctggcttcaaaaatctaccacaaagcggcagagaaaatgcgcggtgaagcatttacagtgaaagaatctatgcctgtagaagaagaactgatcagagtgaattttactaagcttggaatgtatgagtctatcatagaagaaaacacaccgaacctgctggaagaagttgactcacagaagcttttggaaaggaaagatgagatcgcggcggtgatcgatgagatcccttcagccggagagcttaccgatatgctcaaagaagtgaatggggtcagaacccttgaggatcttggctttgacgaaagctttcaggaaaaaactgcaagattgtctccttatgtgagagcaagaattaccttcatgagactgctcaagttttatagtttttatgaagaagtgatcaacggttagggggaaggaagatatgctggaagaattaaaagagcaggtgtatgaggcaaatatggagctcccggcaaaagggctcgtcacatatacttggggaaatgtaagcggaatcgaccgcagaaagggaatgtttgttatcaagccgagcggaatcgcctacgaggaactcagaccttccgatatggtggttatggatcttgacggaaataaggtggaaggggattatcatccttcctccgataccccgacccatctggaactatataaggcattcggacagatcggcggtattgtacacacacattctgcctgggcaacttcttgggcccaggcgggaaggccggttccatgttatgggaccactcacgcagattatttttatggacagattccatgtgccagagggctcagcgcagaagaaatcagggaagagtatgagaaaaacacaggtcttgtcattatagagacatttcagggaaaaaatccatcctatgtccccggagtgctttgtacaaatcatgggccgttttcatgggggaaggatgccatggaggccgtccacaatgcggtagtgctggaagaggtagcaaagatggctgccaggacagaacagctgagaacagaagtgcatgaagcgccgaggatgattcaggataaacattttttccggaaacacgggccgaacgcctactatggaaatgccggaaagtgaggatgcgatgctggaaaacactaaggtctttgttctggatatggacggcacgatctacctggggagggaactgtttccgtttacaaaagatttcctctccaaagtcacagagacaggcaggacgttttatttttttacaaataattcatccaaaagccagcaggcttacattgagaagctggattttatggagattaaaatcacgaaagaacagatgatgatctccagtcatgtgatgatccggtttcttatggaagaacatcatggaaaaagtgtctatgtagtgggtaccccctctttgctggaggaattcaggaaatttggaataacacttgtacaggaagatccggatatcgtggtcctggggtttgacacgactctgacttatgaaaagctttcaaaagcctgcagctttatacgcagcggctgtctctattacggaatcaatccggatctgaactgtcccatggagggaggaacttttataccggactgtggttccatggcaaagcttgtggaggcttccaccggaaggtatccggagtttttcggaaaaccgtcccgccatacactggattatatcatacgggagaccgggtgcaggccggaagaaatagcaatcgtcggtgaccggatttacacggacattgccgtggcagacggaagtaatgtgacgtcgattctggtgctgagtggagagagcactatggaagatgtggagaagagcagtgtgaagccagatctgattgtaaatgatttaagtgagttgacaatgcatctgtagaagaaatatgtgtatttaattttcattatggggagttccgttacggaactccccatataatgtattagtttatgaatgattataagtcaattttgcgaaaatcaatgatcaaattttcataaatcttggattttacactatcatgaaaggtatattccgtaatatcttcattcattaaatcgtgaaccataatcctggacttttcaggatcaacgatccagtattcacgcacaccggcagaacggtatttaaaaagcttgatactgtaatccatgcgcctgctgctctgtgaaacaatttcaataatccaatccggagccccatggcatcccctgttatccagcttgtttttatcacagatcacagatatatcaggttctacataattcatgtcatcattattgagaaagactgcaaaaggtgcaggatagacttcacatgaatcgtttgaactgtcaatgtagtttgctatatattgatttaatttgcttataattttttgatgatttctggtgggcggtgccatataataaatgtgtccgttaatcagctctgcccttgtaccattgtgcatagcataaatatcttcagtggtatagagtttttctctggctgatgacatataaacacatcctttcatggggattataagcagcttaattaataaataagcagtttttttattataatatgagaaggtatttagcacaagtgtacccacttcatttattgttatgctattctttctggtaagaaagtattctgaaagcaaaggagataaatttatggaagataaaaagatggtccgtcaacagatcagggaaaagctgaaaaagttatccacagaatacatgcaggaatcagatgaaaagatacaggagattatcttagagttaccggaatttaagagagccgaaaccgttttctgttatatatccgttggaaaagaggtgtccacggaaaagattttagaagagtgcttccgacagggaaaaactgtgggtgttccgttatgtaccgaaccgggtatcatggaagtcagggaaatcaaggggatggaacagctggaaaatggaatttatggactgttggaaccgaaaaaagatactcttcttatccggaaaaaagaaattcagctggggataattccatgtgtatcagcggacctctgtggaaaacgccttggacatggggccggatattatgaccggtatctctctgatgcagacttttataaagttctgttgtgcagaagaaaacttttgtgggaaaaaatccccacagatgattatgatgtatctatggatttggtgattacagattagattgtacagatatatcgtttatattttttgaaaattattttcaaaccgtctcattgcatggggattaagtatagtctatgattgagaaaaggaggcgggaattatggcaaatgaagataaaaaagattttaataaaatgctctacgaagacaaagggatgcccaaaatacaaattgtgacggatgaggcgacgataaaaagatatggcggggaaaggatgtattttgctcctccagtcacttatgatgagataatgaaaaagattccctgtggaaaagtgattaccgtaggcacgatcagagtctatctggctaaaaagaatgatgcagattttacagatcccatcacggcaggaattttcgtgtcgattgctgcctgggcaagctgtcagcgttctgaagatgaaacaccttattggcggacgctgaaagcaaggggagagttaaatcctaaatatcccggagggattgaagcgcaaaaagaaagattagaagccgagggacatacgattgttcagagaggcagaaaaaatataaaatattatgtgcaggattatgagaacgtgctttttgatttagaaggatgattggttttaaatacgaatgcccaaaatagaacttgcccacattgcccgcggtcaatctgttatattcttcttgaagttattcatcagttttagaacaaaggagaagacatgaacatttgggagaacacagtactgacagatcagggaaaagtattacaggcaaagttattaaagggacagacattaaaaatcaaaagagcagccacagggacgaaaaaagtaccggtggtggatctcagacagcagaccagtgttacggaagggggatatgaccttacgcttcagccggcaaggacagaaggggataagacagttatcccagtactgcttgagaataaaggtctgaacgagagttatgatctatggcaggttggattttatgcggaagaccctgatgagggagagatcttattttgtctttcacaggcttctcaggcaaagaatattcctgcagaggcagaaagccccgggttctcgattacatgggatttttattttaatacatcggatacggcaccgtttgaagtggtattggattctgcaggattggtgagtattgaacagtatcagattcatacagatgaaataaataaggtgagtggaaagattgattgtttaaattcggttttagaaacactaggaacaaagataacagacgttcgtaatgtttttgggtatggcactttccataacggttttattcaaattggaaaattagtttgtgtgtcatttggggttggtctggccgcaaatattgccgctggaaaaaatttatgcagtggactaccaaaaccactatcagatattgcaatattaaatgtatacaatggtgtaatgtctagttattcaagggcaaaagtaactagtgatggagtattatatgtagaatctgcacataactctggagattcactattggtaaatggagcatatattgcaaaataaacttaatatttaactgaaaatgagagactctctaccgatctttatatttttgattaggtttggtattttatcaattattaatcaaggagccatacacatacagttatttcgcaattgtaatatttattatcataataatacaggtggccctgcagtgtaaaatgcaccgcagagccaccctttcatgtattattctatcttttgagccgatatgcacattgtctgtccgtccggtccatatggagctccggcaatatcaccataaacgtttatattgatgaaaccggcttccagtaaatcatgtttgatctcttttagtgtaaatgtatgttcccagacattatacagggaaaaactatcctcggttacaaccgcatactggtttaaaaaagtttgatcctcctcatagcggtaaaatgaatgaagagttaaacatagcttttcactccaaaaaccattttcacgaatatcccagtccgtagtttctttcacgcctttatattttaaaggagtaaaaacatcaaataagaaaataccctcaggaaaaagagaatcataaatctttgccaatagtttctttcttgtatcgcgggacagaacaccaaaatcgcagtatatgagggttatcagattgtactgagaaccaaaatgaatcttcgtgtagtctccttgaacgtatttaatttcttttttagtttggtaagccgaatttttcgcataagcgacagatctgtctgacaaatctatgccggtaacatcgtatcccaggtcgtaaaataattcagtataaataccagggccgcatcccaggtctaataataacggatactcctctgggcaaaagttttctgaaatccatccggcagatgttttcacaaagcttatttctcttgtggctgaatctaaatgctcatttaagtgtgctgccagcatacttttggagatgtgatcgtcatcccaaatattgttgttggtctgttcaaacagatccggtcgtctttctaagagattcaataattttttcataatgttttgtcctttcataatcttgtttgcataacaacaaaacctgtgtttacagattctaaaaaaatacatgcagttcggattatttttcgatttccacgtttcatttatactgctgtttacgcagcatcaaatgcgccggacaaaaccatctcccttatagtaaatatgaatgaattataaaggaagtgcagaggaaagtaaagttttattattctttcgatattccctaggagaacattgatacttccgcttaaacgttaaagaaaaattgctgggactgtcaaaaccgcatcttgtagaaatttcagctatactcttgtttgtgtttataagcagcagggcgcctttggacaggcggtatcgaatcaagtactgcataggtgaaatacccagagtacggtgaaagcagcggaggcattccctctctccgatatttgcggcctgcgcaatatcgcagagctttaatggttcagcataacgggactgtatcatatgaatcatctccttgatcctgaaagaatcctgatctggttttgcagaagtatcagagatctcaggcttataaaatgtacagagaagaaagcaaagtctggaaagacattcccggacggtaaactcatatccttcccggttatttgccaaagcgtcaaaggccatcatgaaacattgtctgatactgacaccggacgtatcttccgcagaaaataacacacagtccaaagtacaggaactgatcagaggatacatatattttttatagaagaccgagctgtcagaaccggagattaaatcggtatggaagaccagagaatgaagtctgcattcattcgaggtctctgcctcgtggaggatgtttgaattgatcacgaggcagtctccggcattcatccgaaaacgttttcccgggacccggacatctaaagtgcctgatggaaggaaaatcacttcgagttcctcatgccagtgccagggaatcctgtttatggcatgagaagaatagacagaatcataacctgcacacggaaattctattgtaccgtggggacacacttccctcctgtcctggtctgtagaaaccgtacattcctgtaaactcataagaaatcctccattttgtcgcttttcttatattataagtctgaatattgattgtttcaattagaaaaagacggtatttatatagatagtacaaagaccagcgaatggcattaacaggaggtatgatttttatgatagatttacatatgcattcttattacagcgacgacggggaatatcagccggaggaactggtgaaaaagtgtaaggaaaaaggaattcagtatatggctgttaccgaccacaacagcgtccgggcagtcggtgaggggagagaagcagcgcaaaaagaagggattcattttatttcaggagtagaggttgactgtaccttcaaagacagaaactttcatgtattaggctatggaattgatgagcagaatccggtatttcagaagatagaagacaatatatcagtgcagagtgaagaagcttccgtaaaaatgctggaggcaacaagaaaactgggatttgacgtgtctgagagtgatatggaaaaactgaccgaaacgatgttttggaaaaaccggtggactggtgaaatgtttgcggaagtgctgcttaacaagccggaatacagggatcacgatctgctccttccatatcgtccgggtggggagaggagcagcaacccatatgtgaatttttactgggattattattctcagggaaaaccctgccatgtggatataacgtttcctgccatgaaagaagtgatcagccagattcatgagagcggcgggaaagctgttcttgcacatccgggacagaatttgagagatcatatggaactgtgggaagaaatcgcagtttcaggaattgacggtgtggaggctttcagcagctatcatacgcctgaacaggcattgtttttcagtcatgaagcaggagagaaacagctgtttatcacctgcggaagtgattttcacggaaagacaaagccgtccatcagtatcagacagcatgggtacagcggctcctgggaagagctgttaaaacagctggaagggattttgtaatcttggtataaacttataaaacaaaaactctgccggaattttttcctgaggcagagtttttgtttttttattttactgagagttcattggccagttttacgatggttccaatcggatcggaaagctcactctggttcattgcatttatataacttgccctgttctcataaacctcatggacggcgttcaagagtgatttggacgtcacttcttcttcgttcaagacataactgtaaccctgccgctggaaagactgggcatttaagatctgatcgccccggctggcatttaaaccgagaggaatgagaatatttggtttcctcaatgcgagaagttcacagatggcgttggcacctgcccgggaaatgatcacatccgcacaggcaaaaagatgtttcagttctttttttacatactcaaactggcagtagccgctctttcccgcaagcattgtctccaggttgttttttccgcagatgtgaatgatctgaaagtcttccaaaagctcgtcaatattctccctgaccgcattgttgattgccacggaaccaaggcttccgccgatgatcagcagtaccggcctggaagatgtaaagtcacagagcttcagtcctttttccctggaaccggtaaagagttcctcacggatcggagacccggtcaggacagctttgccctcggggaggtgttttactgtctcaggaaaattacagcatactctgctggcgcttggaatacttaatttgtttgcaaggcccggcgtcatgtcggattcatggatgatgaccgggatgccaagatgcttggcagcgatgaccacgggtacggtgacgaagccgcccttggagaacacaacatcgggtctcaactttttaagtgttttttttgcatcgaaatatcccttcatgacccggaaaggatcggtaaaattttttacgtcaaagtatcttctcagctttccggaagaaattccgtaatagggaagatcaatatcttcgattaatttcttttccatgccgtccttggacccgatatagctgatcttatatccctctttttcaagagcaggcaccaatgccatattcggagtgacatggccggctgtaccccctccggtcaatacgattcttttcataatacctccaaaatcaaaacaaatgtcatcgggtctctttatattcctttaaagctttggagagctggtcaggacatgaggttccgcggaatccgcactgaatgcctgagaggcgttcgatcacctcatctacctgcattcctttgaccagggatgccacaccggtagtattcccctggcagcctccccgaaactctacattttttaccacattgtcttctatttcaaattcgatcgcattgctgcagacgccttttgtcttgtatatcactataattacctcctgttatatttcttttatggcatattatatcataaaagttccaaaagctgtggtataatttttgtcaggctaaatttattgtttgaaaggagaagagattatgaagataggaatcataggagcaatggaggaagaagtggaatctttgatctcatctatggagaatgcacaaaaaacttcaaaagcttccatggatttttacgaaggcaggctctggggaaatgacgcagtcgtggttatgagcggaatcggaaaagtgaatatggccgtctgcacacagatcctgatcgactgcttcagtgttgataagctgatcaataccggagtcgcaggagggctttataaagagatagagattggggatatcgtaatctccagcgacgcggtgcagcatgatatggacgccgtgggatttggatataagccgggagagatcccgcgaatggagtgttccgtattcagggcagatgaagaacttataagagaggcagaagaggcgtgcaggaaggtcaaccccgatatccgttgttttacaggccgggttttaagcggcgaccagtttatttcaagcgatgaaaagaaacaccggctcatagagaacttcggcggatactgcgcggaaatggaaggagcagccatggcgcagacagcatatttaaacaaagtaccgttcgtagtgctcagggcgatttccgataaatgcgacgatacggcaacagtaagttacagcgaatttgaggaagctgcaataaagcatataattagactgattcacggtattttagacaaagaagcgtcaaactttgtaaggcaataatccgtgtattcccctctttgtgattttataatataagaatcataaaggaagaaggagaaatatcatggatgtattaaaaaacgcattttttttaccgggactgattgcagttatggccgcaggtgtcctgtcaaaacttattgtctggaggaattaccgcaggcttttaagagattcttatgagatggacggaaataagaaacagtggatgggagtgctgaaaaaaaagttcgaaagttactatcagctggaggccaacctgaacaacattccctgtgttgtggacaagtatatgaaaaatcacaaaatagcaggagtgtcttccgagatcatggaacagatcaccggattgtgtgccgttttgagttttttcctgggttgtcttggaacagtacggggatacatagaaggagccgatttaagtgttgtggcagagagtctgtttttaagcctgtcggccggactgtttcttgtgtttgtggacaggctggtcacctttgacggaaaaaaacagctggtcagagccaatctgatccattttcttgaaaatattcttccaaaccgctatctcaaatctgtgaaaaaacaggaaaaagaagaacaggcaaagcagaaggagaagcagaaagaaaaggagcaggtaaaggaagaaaagaaagaagcaaaaaaaatagaaagacactggcaggaagcggccgcatccagagaatttgaactgaccgatgaagaaatgcaggcggtgaaagattttataaatggattataaatctaatgtatacataatagaataataaaaaagcaggaaatcaaaccatgaggaaagttttattattattctgcatcatttgcatgcttggtcttgccggctgccaaaaggaagaggcgcaggtggagactacgaaagtgatcagccagggaagcaatacaaaagaaggatggtggctgaaacgaaataaagaacatcagcagccggaattttcacagaatgtggatctgtccaaatatgacgcatactctgtggatacgaaggcgaaaaataagaaagtgatgtatctgacctttgactgcggatatgagaatggttttacgcccaaaattttggatgtattaaagaaagagaaagttccggcggcattttttgtgacgaagccttttatccgggaagatccggatttagtaaagagaatgaagaaagaggggcatgtggtgggaaatcatacggtccatcacaagagcatgccaacggtttcagacagggacaataagcaggaactcatcgactgtgcggaatactgcaaaaaaacaaccggttatgatatggatatgtttatgcgcccgcctatgggggaatacagcgaacatacattagcgctgacaaagaagctcggatataagacaattttctggagtatggcatatgtggattttaatgtgaacagccagccgggcaaggactatgtagttcagcattttgaagaaaattaccataatggagccattccgctgatgcacaatgtatcccagtctaacgccgaagcgctggagaccgttatcaggaatatgaaggcaaaaggatttgaattccggtcgctgaaaaagctcccggactattgaacagaagggcgttatttgttaaaatatagataacgcatttaaccaagagagacaacagtaaaggagaaagacatgggaaaaattaagtttgattacagcaacgcaaaagattttatcagagaccatgagatcgacatgatcgagaagcaggttgcggatgcgaaagagtatttgctgtcaagaaaaggcccgggaaatgacttcttaggatggatcgaccttcctgtggattatgataaagaagagtttgcgagaatcaaaaaagctgcagaaaagattaagagtgattccgatgtattggttgtcattggtattggagggtcctacctaggttccagagccgtgatcgaagggctgtccaacaactttaacaataagctggacaaagaagtgagaaaagctccggaagtatactttgccggacataatatcagcggtacatatgttaaacagctgatcgatgtgatcggagacagagatttctctgtcaatgtcatctctaaatcaggtacgacgacagaacccggcattgcattccgtatcttcaaaaagcttcttaaagacaaatacggaaaagaagaagcaaacaagcgcatctacgctaccacagacaaggcaaggggagcattgaagacacttgccacagacgagggatacgagactttcgttgtgccggatgatgtagggggacgctttacagtcctgacagccgtaggactccttccgatcgcagctgcgggaattgacattgatgagtttgtaaagggattccaggacggaagagagatgttcttaaacgcaccgtttaatgaaaatccggcgatgctctatgctgccatccgaaacattctcatgcgcagaggaaagggcatggagatcctcgcaaactacgagccgaaccttcactttatctctgagtggtggaaacagttatacggagaaagcgaaggaaaagacggaaaaggcatcttccctgcatctgttgacttctccacagacctgcattctttaggccagttcattcaggacggatcttccaatcactttgagaccgtgctgaacgtggaagaaccggaattagacattgtgctcgaagcagaagaaaacgatctggacggattaaattatctggcaggcaagaccatgaacttcgtaaaccaaaacgctatgaagggaaccatcttagctcatgtggacggaggcgttccgaacttaagatttgatattcctaagatggatgcataccatcttgcgcagctgttctacacatttgagtctgcgtgcggtatgagcggttacttaaactgcgtaaatccatttgaccagcctggagtggaagcatataagaaaaatatgtttgccctgcttggaaaacctggatttgaagacagaagagaagacttattaaagagattataggagaacaaatgaaaaagattgcacagttccataaagtaagttttggacagtttttagaaagctggcaggatacctttgaaggtacctccgaggatgaagtgagacagatttttgacagtattgagcttccaaagagggctaccagaggttccgccggatacgacttttacagtccggttgactttgaactcaaaccgggtgagacgatcaagattccgacaggcattcgtgtgtatatggaagaaagctgggtactgaatctgtttccgcgcagcggccttgggtttaagttccgccttcagatgaacaatacggtggggattatcgacagtgattacttttattcagacaacgagggacatatttttgtcaagctcaccaatgattccaatgaaggaaaaattgtgagagtagaagcaggaactgggatcgtacagggtatttttatggaatatggtgtgaccatagacgatgatgcaaaagaagtccgcaacggcggattcggcagcacaaccaaataacagaaaaaagaccttgcctttaaagggcagggtctttttttgacagaaagtatatgcctgaatatgtaaatatcacgtttttgagagttagtggccaatgatatgatattcaggagaaaagttatataacttccataataccttctagtatagaaacatctgtaatgaaaaaaaggtgaatggcttcaggaatcttcctgatgttccatctgttccagttctgcaggggtatggccggaagctatgaacaggcgggtgtccgcataaagatccatcatcctccccgcaaagttgtctgcctgttcctgatctgcaaaggctacatcgcctttttgaagcatctcaaagatctgttccggatcagctccaaccttcataatataagagatccgatttgtgagatccacagcttctgtcacttgaaatcccagctcatcaaccagataagaagtaaatttcagagatgcctgaccattatcaaaggttccctgaaaaatttcttcacgggatggatgataataggcatagtccttccggatcgaagaaatatcctcaaggaggctgggatcttcaagaagcatagagtctacaaacattttattatgatatccgaaactgaaggcatgagggcttggcagaaaataaaggttgatcaggtccctgggcgtgatctgtacctgctcatactcgttgtacagttctgcaatatgctcaagcggcgcggctccgaaaatacggacacagtaataacagtactgaatctgtttccatgtcagttccctgcgtttcctgaaattctcagtattcatggcggagtaggatgcagatacatccggcggaatataaatttcgtcatcctcatcaacggcacagtagcctccgtccagaaaggcatcaaagatatcttcgtcatcaatggggaagtatccatccagcgcagcttcaaatgcccggatctcaagatccgtaagggtcagaaaaaagctgcccatagcgtcaggttttatgatatattcagaaagatatgaggccagatcaggcttttccatctgtgaacagtggtccagctgatggatatgggcaatctccagaagatcatcttttgtatactgaagataaacatccctgagggaatcggaagaaaaagagggcgggacgtcttctgttttttttctgagggtttctgaaggctcctttgttccgtcctccaagaagcagaggttttccttcatagagagattgagatcttccaaacgggtatctgcacggaaatcgcctttatattttatgatttccggaaaacggttttggtaagcggggattaatttttctgtctctatccgaaactctgtctttccctttaaaatatatgtgtaatcaataaattgtttatccttcatgtaagaatcgatcagcagagaattatcaaagattctttgatggtgcacagggatttcaaaacgaaacagacaccgcccggatttttggaatgcggcctgtataatttcgtggagaccggaaaatgatatacagtcaggaatgaatatacgtctccacatcggtggcctgctgttttttatgatgacttttatctgatatccgcccataatcaacctcctgtctgtaatgcttgtgccgaagttttattacattcattttatcacataaacagggcagaaaaaagacggagcaggaatcctcctgatccgtcttttctgtcatagattcatgattatgaaaactgtcctacccaggtctcgatcttggcaccgatagcttctgcatcctccatggaggaacctttcaccccatagtagaacttgatcttaggctcggttccggaagggcgcacgcaaagccatgcgttgttttctaattcgtagtagagtacattagaagctggaagtccggttggcactgtctcaccggtggtaagatccgtgatcgtgtcgttctggtaatcgcgggattttaataccttgagccctccgatttctttcggcgggttctctctcagagacttgagcatgttctggatcttttcagctccgtccagtcctgcgaattcaagggctttcactttatccagataatagccgtacttctcatacatgtcggtcattgcatcccacaaggtcttgccctgagtcatataatatgcagcagcttcacagagtgccacagttgcggataccgcatctttatcccttgcataagttccgatcaggcagccgtagctttcttccagaccgaacaggtaagttcctttgcctgtattttcaaagttcagcatctgctgtccgatgaatttgaatcctgtgagcacttcgatcaggtttacgccgtagccgtcagccactgcgtctaccagattggttgtgacaatcgattttacaacggctccgtcatccggaagtgatccgttcatggctttcttctggcttaggacatattcacacagaagagaaccggacatgttgccggtcagagcgatatagtctccggtctttgaatctttcacatagactccgagacggtcggcatcaggatctgttgccaatacaaggtcggcatccttttctctggcaagcttcaggccaagttcaaatgcctctttggattccggatttggatagcttacggttggaaaagccccgtcgggaagttcctgctccggcactacatagacattctggaatcctaaatcttttaatacgcggcggacagggagatttcctgttccgtgcagaggagtataaacaatttttaatttggatgccatctggtcaatcgcatcctgattatgtacttgcttttctacttcggcgatgtatgcatcgtcgacttctgagccgattacctcatataatccggcactgactgcatcttccctggacatggtcttaaccttggaaatatctgtgacggcgttgaccttggcggttacccctttgtcgtgaggcggcgtaaactgcgcaccgtcctcccagtatactttatagccgttatattccggaggattgtggctggcagtaatgttaattccagcaatgcagttatagtagcggactgcaaaggacaattccggggtcggacggagtgattcaaaaatatatgctttgatgccgtttgctgccaggcacagcgctgcttcgtcagcaaattccggagacatatgccgggaatcaaaagcaatggcaacgcgctttttgtccgtgccctgttccagaatgtagtctgcgagtccctgagtcgccttgcggactacatagatattcatacggttgatgccggcaccgatgatcccgcgaaggcctgctgttccaaaagccaggtcagagtaaaaccgctctttgatctcgttgtcatcatcctgaatgttcttaagttcctcttttgtagcttcatcaaaatatggattgttaagccattcctgatatgtttcctgatagttcatagtagtgctcctcctttacgtttttccttatgttttattataacttatctgggcctaaaaaacattataaaagttgtgatattgtaaaagaaatttctctcttttttcttttaaatcaacaatatcctgaagcttattgagatatcttggagatacccagtgttttttatgattcatgtactgatttgagattttccaaagcttttccgggtataaaaaaagcacatacaaaaaagaataatcattcattgtgaggcgctgaaccttactgtagcctttcagcatagtctcacagatactgaactgatactcatttttttccagagcctttcggataaaataatacagatcggtcagaggatagccataataaaaatgttcaaagtgaagtgtagcagtcccatggggtcccatcaatacattgtgatggttgtaggaaccgtggcaccatccttcccttaaccctgtaagttcttccatttttgcgctggaatcctcaagctgtttccaaaatggctgaatttcctgcaaaaaaagatactcgaagtctcctttgttctttctgctcccgatatatttccaaatacttttgagctcccgtctccgctgatgatagctttttgtcagggagaaatgaggcgttccgtagtccgcacggtagggaattctgcctgacgcgcggtggaaagaggcaagattcctgcaggcggaagacagatcggaaggagagtggatattgcattctgtaccattgaaagtccttctcataacaaaaggctcatagtatttatcataagaaataaattcatgttctttgttttcgatatattggtcaatttttgtaaatccctggtcaatcaattcttctttccactgatgctcgacagccagacgttcttcggacagtttcgtagcagacagggcaaataacccctgatcagtgccgcagatgatctcgccgcggcctctttttaaataatcaacatgcagatcatattgatctaaaagtattttgtatttgtcgttcacaatatgccctcctcaaagttctacctctaattgtatgtgcccggggtgccggatatgatatcgtcttgtaattcggaaaaaaatgaagtatactggtactaatctaaatgttacaaatgttacagaagtacaattggaggaacgaaatcatgagaaagaaatatttacttataacatgtatgctgatgatcggggctgtcggcctgatggcatgcggaaagaagagtccgagttctgaggtttccacagaagccacaacggctgaatcagaggagacgacggccagcgaggaagtttctacggtggctaccgaggagacggaagcgacaacggaagcgggcaaaactaccacagaagcgacgatcgcagacaaaaaggatgagaagaagaaaccggtaagtgcaactggagtgtacaatggtttcggcgacagtaattcagtggaagtaaagatgtccaacggggaatacaagacgttcatcattgaggatgaaaaggttatggatgccttaaatgacatggaaccgggcacaaagatctcctttacttacggagcattggaaggccaggcaaacatgcagattttatccgtgaagaaaaaataagcgtaaaaagcacataggaatttatggttcctgtgtgctttttcttacaatgaggggaagggcataggtatgaaaaaatcaggaaaaatatttcggagactgaccgttcttttatttacaggattgctcagtattacattttcagctccgagggaggcttcggcagcatctgcaaagtatgcagcttattcagaaaacaatatttataaagtgggaaaacaccgctataaggcatcagtcaaaaatcagggaagccgtccgaaagccatgctgtatcggaagaaaaaaggaaaatggaagaaactgctgacgcatcagaatacttatggcataacggtaaaggccgaatatggaaaatggctgtattattctgtttacccctatgattccgatcagcatctgtatcgtttcaatctgaagacgaagaaaaagtatcttgtgcgacggaacgtgcgtcacatgctgatttcaggaaacaggctttatacaaatggatttgccaccgatgcgagaagtgttccgatctatgtgagcaggacaaacggcaaaaaggcaaagtgtatcacgaaaaaagccaaccaggcgaggatgaaaatctatggaaaacggctttattatctggaatgcacttacaaccggcagcacacaaagagtacggaccgccttgtgagcaggaagcttaacggaaaaggcagaaaggttcattcaaaaaagatcaaaagcccgtcttcggtgctgtctttcagcagccggtcactggtctatgcaaaaccggtctccgggacaatgagatattacagaatcaatcttaaaacaaagaagcaaaaaagaatctatccctcagcacgcagggtagatcagtggatacggaacttttattaaaaaaccgcggcaggactttaaagtctgccgcggctttttgctgccgtctctgttttcttaatagtcttctgaatgaatctggaagaattttttcggatgtgcacagaccggacatacttcaggcgcctcggttccgtaatgtacatgtccgcagtttgtacagatccatgcctgttcagtatctctcttgtaaacaatccctttgtcgatattttctgtcagctgctgatagcgttcgtcatggcgtttttcgatgtctgcaaccatctcaaacagtgctgcgatttcatcgaaaccttcctcttttgcttctttggcaaacgttggatacatatctgtccattcaaaattttctcccgcagcagcatcttttaagttcacttctgttgaaggcattccgtcatgtaatagtttaaaccagatttttgcatgttctttttcatttaatgcggtttcagcaaagatgttgccgaactgcacatagccgtctttttttgcctggcttgcataaaaatcgtattttgtacgtgcctgtgactcccctgcatatgcagccatcaagttctgttctgtcttcgttccttttaaatttggcattccacataacctcctgattctataatagtaattattactgttttattatctcagatataagtacataagtcaatacatactctgttattattatggtacaataaggataaaatattcaattaatggacgcattgtatgcttaaaggaggcggccctatgagaatgtatgatctgatcttgaagaagagagatgggtattccctttcaaaagaagaaatcaggtggatgatagaccactatttacatggaaatattccggattatcagatgtcggcaatgatgatggcagtgtatttcaggggaatggacacacaggaaacctttgaactcacgatggccatggcagagagcggcgaccggctggatctgtccggaattccgggtataaaagcagataagcacagcaccggaggagtgggggataagacctctcttgcgctgggaccgctggcggcatcctgtggtgttcctgtgacaaaaatgtcgggaagaggactggggcatacaggaggcaccattgataaactggaaagcattccgggatttcagactgcgcttacagaagagaggtttatggaacaggtagcatccgtgggcatagcgatcatgggacagacaaaagacctggcaccggcggataagcttttatatgcacttcgtgacgtgacggctaccgtagatcagatctcgctgatcgccagcagcattatgagcaaaaagcttgcagccggagcagatgctatacttctggatgtgaagtgcggcagcggtgcttttatgaaaaactttgaggatgcaaggaagctttcggaggctatgatccggatcgggaaaactgccggaaaaaatatggcagcggtcatatcagatatggatcagcctctggggagagcagtcggcaacgcgctggaagtaaaagaggccattgatacactcaagggagaaggccccgaagattttacggagcttgtgctgacacttggctcccggatgctctgtatggcagagagagcagaaacgccgcaggaggcacaaaaaatattaaaacagaagatcacggacgggagcgcgctgcataaattcacagaatttgtcatggcacagggtggagatccgtcctggatcgaacatccggaaaatttctgcagggcagattatatagaagaaatcccttctgtaaaaaccggatttgtcactgcctttaatacccaggagatcggggtctgttctctcctgctgggcggaggaagagagacgaaagaaagcgcggtcgacccgtttgtgggactggtactccggaagaaaaaaggagagtcagtaagaaaaggagaagggctggcagtcatatacgccaatgataaagaaaagctggcaaaagcaaaagagcattttttgaaaaacgtaacgattgagtctgagaggaagatgccggagccgctgatcaaagagatactttcttaaaagaattcatgagaagctttcttttttcatatgttaataaaaaaacggagcgctctatgaaaagatatatctatatcatgttattcatgatgactttaggctgcttttgtgccggatgtttaagacaggagaagcatggcgcaaaagagaatgtagactatgcagtctgcaaaaaagaaaatctgccgaaagaattaacggcaagaattaatgaacagaaggataaagtttttcattttacgtattctatgaaagagacaatgtactatgtgatcggatatgggaaacagaccggaagcggatataagatccgggtgaaaaaaatgactatggatgaaggccatgtctatattgacacgaatctgatcggagttccgaagcggcagcaggaaaaaggatattcgtatccatatatcgtgatcaagagccagaattatgaaaaagacgtagtatttttgtgatatgtcacaaaaactttagaattgttttattgattttcaagcagtgaaaccatataatggagtctataaatgcttgagaagatcgaaggaggaaaagcgttcgtggataatagacagaagaaaccggataaaaataacaagaattcgattcagatgattatatcgattttgattacatccattttagtggctgtcttgtttaactttgtagtaggcaaatggaaaaacggtacagagaccgagatttcctacggcaagtttgtcaagatgatcgagaaaaaagaaattaaaaaggttgtgtttgaaagtgatgtgatcacggtcatcccgaaagaatcagagaacccgctgtataagactacatacaaagtagtccagcttcccgtacctgattatcagctggtcaaccggctggagaaggcagggatcgaaaattaccaggcaaaggcaaaggacggatctgaggtcctgatgagtgttcttgtgagcattctgcctgccatcattatctttggactgctgatgtttatgatgcgcggaaagagcggcatgatgggcgtaggaaaatctaacgccaaggtctatgtggagaaaaagacaggtgtcacttttgccgacgttgcgggacagcaggaggccaaggagtccctgaccgagatggtggatttcctgcatcaccctgacaagtatttaaaaatcggtgcgaaactgcccaagggagcactgcttgtggggcctccgggtaccggtaaaaccctgcttgccaaagcagtggcgggagaagcaaatgttccgtttttctccctgtccggttctgatttcgtagagatgttcgtcggtgtcggtgcgtccagagtccgtgacctgttcaagcaggcacagtctatggctccgtgtattatatttatagacgagatcgatgccatcggaaaaagccgtgacaccggcatccagggcggaggaaacgatgagcgggaacagacattaaaccagcttttatcagagatggacggatttgatacttcaaaaggacttgtcattctggctgctaccaaccgtccggaagtgctggataaagcgcttctgcgcccgggacgctttgaccggcgcgtcatcgtagagcgtccggatctgaaaggaagaatcgagacattaaaagtccattccaaagatgtcaagatggatgagagcgtagactttgaagagatcgccctggctacatcaggggcagtggggtcggatctggccaatatgatcaacgaagcggcgctggccgccgtcaaggcaggaagggagtatgtgtctcagtcagacctctttgaggctgtagaagtagtcatcgccggaaaggaaaagaaagaccgtatcctcggcaaagaagaaaaacagattgttgcataccacgaggtgggacatgcgcttgtcatggcgcttcagaaggagtctgagccggtgcagaagattaccatcgttccaaggaccatgggagcgctcggatatacgatgcagagaccggaggaagagaagtacctgaataaaaaagacgagatgctggcagacctggtatctttctttggaggccgtgcggccgaagagatcaagttccatacggtgacaaccggcgcgtccaacgatattgaacgggccacggccatcgcaagagccatggtgacacagtacggtatgtcagaagagttcggcctgatcggtctggaatccattaccaaccgttacctggacggacgtcctgttatgaactgtgcggaatccaccgccgcaaaggtagaccaggtggttatgggaatcttaaaagatgcatataaaaaggcacttgacctgatcagggccaatatggacatcctggatgaggcggcacagttcctgatcgagaaagagacgatcacgggaaaagagtttatggaaatttttaatgccaagaaagaatcttctgaacaggaagaggaagatttcagcgaagatgctaaaagctcagcggcagatgatgagacggtacaggaacagccgtcagaagatatggaaaataatccacaggatatgtaacattctggttatcccatgtatagatttgacaggattcggttataatgatacaataaagtttacagtatacagaaggtgtcacgagttctgtatagatagaatggggtgaaagaatgacacagatggatattcaatgcattcgtaagtcaattcaggagcgcattggcagcaaaatcaagatcagctcaaataaaggtagacacaagtttgtaacttcacagggagtcattacggagacatatccgaacatttttctggtagagattgaagacgacagcagtaccaaaagtaaaacggtcagtttcagttatcaggatgtgatcacgaaagatgtcaggatgatgctgctggaaggctgacactgtaccggatacaattttaatcttgaaggaatagattccttcctgtctgaatatatttgtatatacaagacagggaggaattttttatggattttaacaaaaaggatttttatggaatcgtcgcaaaagaacgaaagcaggtacaaataacaatcgaccaggactgtaatgtgcctgatacgaagccggatgtggagaagatgattcagactaaagggctggtgatcatgcaggagacagagatgatggtggaccgtatccggatcaaaggagaattccatttttcaggtctgtacgggacaattgacgccaggacctatttagagtctctggattttgttctcccttttgaggagtatatacatatggacggcgctgtgccgacagattatgtgaaagtttcttatgtcattgatgacatcaacacagtgctgatcaattccaggaaactgagtataaggattcttctgactctgaccctccatgtcaacgaggagattaaagaggaaggcattatcgatgttctgggcgacggaatatcttccctgaaaaaggaagtccaggtgacagacctgatcgtcaataaaaaggatattgccagaatgaaagaggaactggtgctgccggccaataaatccaacatctatgagatactctggagccaggtggagcttgagaatgtacagggaaaattaaaagaccacagcatcgacatacagggtgatatgcatgtgtttatcttatatctcggagaggatgaacagcttccggtccagtatgcaagatgggagatcccgctgcatacagagctggagtgttatgaatgtgcaccgggaatgatcggcaagatccacatttccctcggaaaccatcagctggagattcgtccggacgtggacggagaagagagagtggtatcggttgacgcaactcttgagtgtgatattaaagtctacgaagatcaggtgctgtcttatgtgggagactgctatacaatgaagaaaacactggtgccggagtacaaagactttgcatttgaatctctgattggaaaaaatcaggctacgatgaagatggcgaagcgtttttccatcgagcaggagccgggaaaacttttgcaggtgctttctgtgaaaggaagctgcaatatagacgatgtggaagtcaaagagcaggggcttcaggtggagggtgtcctgatggcagatgttctgtttttgtccagtgaggaccagaacccggtgatgagcagttcctacatggaaccgttctcttactttattgaggctaagggtctgatgaaagaggacgattatcagctggatgttatgctggatcatatcagtgccactccgacggaaggggatgagatcgagattaaagcaaatgtgatatttgacttcatctctttccacaaaaaagcagaaaagatcatgacaaatgtagctgagcagcctctggattatgaagaactgcagaagatcccgggaatcgtcggatatatcgtgaaggacggagatactctgtggtccatagcaaaacgttattttactaccgttgacgatatccgcgatcaaaatgagggtattgaggaagtaaagccgggtgataaactgttaattgtcaaagaaattggatggaattgataaataggattgcatttttataggaacaatactataatgttctgtatacaatactaagtttcagcggcaggagacagtgaggagtacagatgaaaaaggtagttctgaaagcttatggaaaagtaaatttagggctggatgtagtaaggcggagagatgacgggtatcatgaagttaggatgatcatgcagacggtgggtctttttgacaggctggagcttaaaaagacttccggtgattccgttacactttccgccaatcttagatttcttccggtcaatgaacagaatcttgtctgtcaggccattgcagccgtaaagaaaaagtattcaatcaaaagcggcgtggaagcgtatctggaaaagcgtatccctatcgccgcaggcatggcgggcggaagctctgactgtgccgcagcactgagaggaatgaaccggctgtttgaacttggacttaaggaagaggaactgtgtgagatcggagccgggctgggagcggatgtgccttattgtgtcataggaggaaccgcactggcagaagggattggagaaaagcttacaaagctgcctcctgtgccgcactgccatatactgatcgccaagcctggggtcagtgtgtccacgaaaactgtgtatgagaatctggacgtgccgggccttttatcacacccggatattacaggaatgatatctgccattgaaaatcaggatttgaaggggatcacggggaggatggaaaatgttctggagacagtcaccataccaagataccctgtgatccatgagatcaaagagttcctgctgaaacagggcgccgagagtgcactcatgagcgggagcggaccgacggtatttggaatatttgcttcagaggaaaaggcgcagagagccctttccaatctaagatcttttgaagatgtgaagcaggcctatgtggtagcgccggtcaatagagaatcataattggagggaacgaaagatgagcagtgataaattaaaagtgaacgtcaatgaatatctgccgctgagggatgtggtgtttaatacactcagacaggcaatcattaccggagagtttgtacccggagagcgtttgatggagattgccctggcaaaccgtctcggagtcagccgtaccccggtcagggaagccataaggaagctggagcttgagggtctggtcgtcatgattccgagaaagggcgcggaagtagcccgcatcacggaaaaagatttaagagatgtcctggaagtgagaagctctctcgaagaactggcggcaggacttgccacggagcgcctggatgatggttccagagagaagattcaggaagccctggacaatttccgtgaggcgatccagacggatgataatcctaagatcgcagactgtgatgtggaatttcatgatgccgtctttgaggcgactcaaaataagcggctgatccagatcatcaataatctgagagaacagatttaccgctaccgtctggaatatgtcaaggatacggcatatcatgcggttcttctcaaagaacacgaggaactggtggaagccatgttcgcaggcaacaaagagagagcgaaagagatcatgaaacgtcatatcgacaatcaggaagagacggtaatcaaaaagattcaggaagaagaaaaataggtccgtggactttcagacagaactctgtgcgtgcgcatagagttcttttttttgctcatactactttaaaaggtggtgtgaaaaaatggatcgatttcatgataaaaatcacaaaatgaaaggtaaaatatcaaaggatctggagcagaatattgcatatctcgaagcagtattttcagactgcaatgatattgtaaaaaagaagttttacgttgggaagaaaaaaaacacaggaatgtatgtgatctacacagacggtcttgccaaagctgacatgatccaggaaaatgtattggaacctctcctcacagaccctcttcaccctctgaaagagtctgtgacctcctgggtcattgagagtgcagaccggaagatggtcacgaccatggatgaagttgtcatggccgttttatcaggagatacggtactgttttttgacgggcttgatcagggaatttttatatccagcaagtttttccctaccagaggagtgcaggaagccgacagggaagtagccatgatcggtccgaaggacagttttaatgaaagcctcaggaccaacacggctctgatccgaaggcgggtcagggatacgagaatgaaggttgtccagctcaggatcggaacaaggagcaaaacagatgtagcgcttatgtatattgaagatctggccaaagatgaggtagtaaaagaaataaaaaaacagttggatgaactgaatattgacggaatttttgacagcggaatgctggaacagctcatggagcaggacagcaaatctccgtttccccagtatcagctgactcagagaccggacaaagcggcaagcggactcatggagggaagaattgtgctcgtggtggataattctccggaggtcattgtgctgccggtgacactgaacattttctttcaggccagtgatgattactataaccggtgggaagttgccacatttgccagaatccttcgatacatttcttcttttattgccattgggctgccgggattttatattgccattgcaaattatcatcccgagattcttcccacaccatttatgctgtccattgtgtcagccagggagggagtgcctttccctgtggttgtggaagtactgcttttggaacttgcgtttgaacttttaagggaagcgggtatccgcctgcctggacagctgggcggcaccataggaattgtaggaggtctgatcgtaggacaggcggcggttgacgctaatattgtcagcacaatcgtggtaattgttgtagcctttacagccatcgcgtcgttttctataccaaatgagagcttttcaggggtgttccggctattgagattttctattatgcttgtctgtgccatatgggggctttatggattctttctcggattccttgcgattgcgatccatttaatgaagcttcagagctatgggatcccgtatctgtttccgaccgtatcagccacggtggaagagacggacccctgggaggactatatggtgcggctgcctatcaggcgtatgatcttcaggccatggtttacgaaggacggggcgaaaaaacgtcagggaaggaggaaacatcatgtggacggcgaatcttgaaatttctaaaaagcagggaagcaggatctttcttctggaaaccttctgcggagtgggcatgttccttccccaggcagctgccctgaaatctggtgaaacagggctttatacggtactccttggagccattgccgcagtctgctatccatggcttgtacaaaaagcagaaggcagtctgactatggaagaagtattaaaaaaacaccgggtgatttcctttctctattatgtgagattttttataaacgctgcatttttttatgcatacatgctgctcttggccagggtgttcctgcttccgtatatgaatatttactggatcgggctgccggttatttttctggctttccggatgaacggagaggggctggacgacagggcaagagtcatggaagggctgttctggtttattctgatcccatttatttttatccttcttctcagcatgacggagttttctgtgaaaccctttctgatccggcagtttgaaccgaagaacctggcggtgggcggattgtatgtgctcgcactgtttcatcctatggaactggtgtggttttatcaggggcatatgaaggaaaagggaatgaataaaaagacactgctcggaatcataattttatcggcgggagtgtttgccgccacggcgggaagcctggggcttcagatgatcaggagggacccgtttccggtgatttccatggcacagaatgtagcaatgccaggggggatcatggcaaggctggacatttttctgatcgcattctggattgttggagttttttgtgtgctgagcggatacctgttctatggaaactggagttttgaaaacacatttccggggaaaaagaaatggggcagatggatttcctacggcggactgtttttaatcaccggatttctgatccccatggtccgtctttgggaaaattatatttctgtgttcctttttgctaatctattgctgggaattttaattccggcagttttgttttggctggaacggagaggaggcactcatgaaaaagatcatcattagccttttgatggccgcagtcactgcagcggcacttacgggctgcaaagaagccggggacatcgaggacagcagttatgttttggcaatgggcattgaaaagacagagaacgggtatctgatcgattattcctgtgcagatttttccaaggctcaggacaatcagggaacgaaagtgccgtccaagtctgtggtttactcaggcaggtcttttaatgagacaaatcaaagttttgagcaaactcagccgaaaaaattaaacttcgggcatttaaaggtgatcgtatttaccaacggacagattgatgatactatgatagaggagcttttagatcattcagaaatcgcaaaatccgtgctgattcttaaaagtaaaaaacagttaaaagagcttttttcgatcgagaaagatctgcctgtctcatttggtgaatacatggccaaaggcattgaaagttccccaaaagtgaaaaagcccaaggatctgagccttggcaggatttacggcagaaagtgacagaaatcagtcttgacttggatcggatgagatggtaagatggatacattcacacaagatatagtagaataatagatcatattaaacaatatatagtaatttgattaagaaaatagcgaagagtcccctgcctgcggtgtctcctgctttcagcgggatatgccgcaggcaggacgatgctctgggaacagtcagggaggagagagtatgatacgggtagtaaagaaagatggaacaaaagaagattttaatattcagaaggtggtgacggcagtaaataaatccgcctaccgtgcccttgtgaaatttacggaagatgagcttgatgagatctgccggtttgtcaatgggagagtggacgagcttaataagtcagaagtacatattacggagatgcacaatgtagtggaaggggctctggagagggtaaatcccggcgtggccaaaagctaccgggactaccggaactataaacaggattttgtggaaatgctggatgatgtgtataagaaaagccagtccatcatgtacataggagacaaagagaacagcaatacagacagtgcccttgtgtctacaaagcggagcctgatctttaatgagctgaacaagtctctgtatcagaagttctttttaacgaccgaagagatccaggcctgccgggacggttatatttatatccatgatatgtcggccagaagagatacgatgaactgctgtctgttcgatgtggaggccgtgttaaaaggcggatttgagatggggaatctctggtacaatgaaccaaagacgctggatgtagcctttgacgtcataggagatatcgtactgagcgctgcgagccagcagtacggcgggtttacggtgccaaatattgaactgattctggaaccttacgcggagaagtcttatgaaaaaggcattgaaaagtatgaagccctcggcctttccagagagcgggcggaagctgagtcattgaaagatgtccagaaagagttctgtcagggattccaggggcttgaatataagtttaacagtgtttcttccagccgcggagactatccttttatcacagtgaccgcgggaaccggcacaggccggtttgcaaagatggcagcgatcacgatgctggatgtcaggaggagaggacagggaaaagaaggacataagaaaccggtgctgtttccaaagatcgtatttctttatgatgaaaatcttcatggaccgggcggagaactggaggatgtgtttgaagctggaatccgctgttccagcaagacgatgtatcctgactggctgagcctcacaggggatggatatgtccctgacatgtataaaagatatggaaagatcgtaagcccgatgggctgccgtgcctttttatccccctggtatgaaaagggaggggcagagcctctggacgagcaggacgagccggtctttgtgggccgctttaacatcggggcggtaagtctgcatctgccgatgatctatgcaaaggcaaaacaggaaagccgtgacttctatgaagtgctggactattacctgaatctgatcagagagcttcacagaaggacctacgattatttgggtgagatgaaagcatccacaaatcctttggcatactgtgagggaggttttctgggagggcatttgggccttcacgacaagatcaagcctttgcttgcgtctgccacagcttctttcggcatcacggcgctcaatgaacttcagcagctgcacaacaaaaaatccattgcccaggacggcgcatttgcactggaggtccttgaatatattaacagccaggtaacgaagtttaagaaagaagacggacatttgtatgcgatttatgggacaccggcagaaaacctctgcggacttcaggtgaaacagttcagaaagaagtacggtgtgatcgagaatgtctctgaccgggaatatgtgagcaattctttccactgccatgtttctgaagacctgacaccgatcgagaaacagaacttagaaggacgtttctgggaaaaatgcaacggcggaaagatccagtatgtgaagtatccgatcagctacaataaagacgctatacggacactggtaaggcgtgccatggaccttggctactatgaaggggtgaatttatccctgtcatactgtgacgactgcgggcatgaggagttagagatggacgtgtgtccggtctgcggaagcagcaatctgacgaagatcgaccgcatgaacggctatctgtcttactccagagtcaagggagacacgaggctcaatgacgcaaagatggcggagattgccgaccggaagtcaatgtagggaagctgccatggtttatattggagcagtacttttagtaatcggttcaggaatcctgattcagcctgtggtaaaacaacttttttacatacagaggtattctgtgaaagtgcgggctgtctgcaccggacagaaaccatatgtcaattatttgaatttaaaaatgaaaaatcctgtttttacttatacatataaagacagagagtacacttcagtactcgggatgtataaatacagggaaaaagaagaatatgcagaaggacaggaagccgaggtgctgctggatccttcaaatccaaacgaaatttatataccgcagccttggatgtctctgtttgggacagaacgtctcctgccgtttcttgtctttgcggcggcgggactgtggatgatattagcgtagaggtgggaagtatgaggtatcacaacattacaaaggacgatatgctgaatggggacggattaagagttgtcttatggctgtcaggatgtacccatcagtgcagaaactgccacaatccggttacctgggatatccatggcggactggagtttgacagggaagcaaaagaagaactgtttaaggagctcggcaaaaattatatcagtggtctgacgttaagcggaggagaccctctgcaccctgagaaccgggagccggtgggacagctggtaaaagaggtcagagaaaagtttccggaaaagaccatatggatgtataccggttttctgtgggatgaagtctgtactctggatgctgtaaaaaataccgatgttctggtagacggtcgttttgaggaggatttaaaggacaccgctctcaaatggagaggcagttccaaccagcaggtgatcgatgtgaaaaggtcgctggatcagatgaaaaaagtgctgtacataagataaaacaaggcttgacggcctgcctcttccgtgatacaatgtgtaagctagactttagcgttggaagaggtcttttttttatgccttattttaaaaacaatggaggtggaagttgtgcgcacaaaaatcacattagaatgtacagaatgtaagcagcgtaattacgatatgatgaaggataagaaaacacatccggaacgtatggaaacaaaaaaatactgcaagttctgtaaaagacacacattacacaaagaaactaagtaatgcacgtttatttaaggaagtgagaacatgaagaataccagcaaatcaagcaaaaccagctggttcaaagaattgaaatcagaattcggaagaatcatctggccttctaaagaacgcattgccaaagaaacgggcgttgtggtcgtgtgtgctattatcattggtattattattgctgttctggatttgggacttcaatatggaatcaagatgttagtagggtaaaggtaaggagagcatatgacagaaacaaattggtatgtagttcatacctattccggatatgagaataaagtaaaagcaaatatcgaaaagacgatcgagaaccgcaagcttcaagatcagattttagaagtccgggtaccgcttcaggatgtaacggaactgaagaatggtgtaaaaaaacaggtttccaagaagatgttcccaggatacgtgctgatccacatggtgatgaacgacgacacatggtatgttgtcagaaacaccagaggtgtgacaggattcgtaggccctggttccaaaccggtcccattgacaccggctgagatgaagccattgggaatcagcgtgggcggtacaaatgaagaaacgcctaagaaggaaaaaattgatattgatgttgaagtaggtgatatcattgttgttacttccggtgcttgggaaggtacgacaagtgcagttaccgtagtaaatgagcacaaacagacagtgaccatcgaggtggagatgtttggacgtgccacatcagtagaaattgatttcttagatatcaaaaaagcagagtaaatgacaaaacctctgcacgtaacaaggtgggagggatatctcccgtaattaccacaatcatcaggaggttaacgattatggcaaagaaagtagaaggatatattaaacttcagattccggcaggaaaggcaacaccagcaccgccggtaggacctgcacttggtcagcacggtgtaaatatcgtacagtttacaaaggaatttaatgcaaagactgcagatcagggagacctgctcattcctgttgtaattacagtataccaggacagaagtttcagctttgtgacaaagactcctccggcagcagttttattaaagaaagcctgcaagatccagtcaggatccggagagccgaacagaaagaaagtcgcaacagtatccaaagcagatttacagcagattgctgagacaaagatgaaagacttaaacgctgcatcaatcgaagctgcaatgagcatgattgcaggaacagcaagaagcatgggaatcgaagtggaggaataggcattaaacacttaatgagggcaagccaaaggcgcaggccgaatttagtgtgaaagccgttaccgagactcagtgaaggcgagtcgaagacgaagcctgaacgcttagtcgagtgtaacttccttaaatttagaaagtgggagggttgctcccgatatgaccacaggaggtatttttagaatgaaaaaaggtaaaagatatgcagaggctgccaaattagttgacagaacgaaactgtacgatgtacaggaagcagtatctgtagtaaaaaaagcagcgaatgctaaatttgatgagacgatcgaagcacatctccgtctcggagtagacggccgtcaggcagatcagcagatccgtggagcagttgtactgcctcatggaaccggtaaaaaagttcgtgttcttgtatttgcgaaagatgcaaaagcagaagaagcaaaggcagcaggagcagagtatgtcggagcagaagaactgatccctaagattcagaaagaaaactggtttgactttgacgtagtagttgcaacaccggacatgatgggtatcgtgggacgtttaggacgtgacttaggaccaaaaggcttaatgccgaacccgaaagccggtactgtgacaatggacgttacaaaagcgatcgaagacatcaaagcaggtaagatcgaatacagactggacaagaacaacatcatccacgtgccagtcggaaaagcttcttttacagaagaacagttagcggacaacttccagacgttaatagatgctattatcaaagcaaaaccgtcagcagcaaaaggtcagtactttaagaatgtgacaatcacttctacaatgggacctggagttaaaattgacacaggcaagtttgcttaaataaaatagttaaagttatgacaaacccctctatctttttagaggggtttttgaatgcagtaaattgtgtgccatgcgtgcaaaaagagaggaaaatatgaaggatttaacggtagggaaaccatttgaagtcatcggaaaatttgcgctccctatgattctcagtatgatatttcagcaggtgtacagtgttgtggacagtattgtggccggccggttcatcggagtcagtgcactgggagcagtaggtgcgtcccagcctattacagttatttttattgccatagccgttgggaccggcatgggaattaatgttgtgatatcgggctttttcggagcaaaaaaatataagagagtaaaaagctgtatttccacggcggtgatcacgatcgtaattatgagtgctgtcctgactttcttagggctgctgggctgcaggtggatgatgggagccatgtccactccgggggatatatttgaggattctgcgctgtatctcaggatttatattatgggaattattttcctgatgctttataacggtgcgaatgctattttcacagcgctgggagattctataactccgctgatatttttgatcttttcatcggtcctgaacatcattctggatgtactgtttgtcactgccttttccatgggtgtcgcaggggttgcctgggctacctttatagcccagggcattgcctctgttctggcggtggtcacggtatttaaaaagaattccaaaattcaggccggaaattatcggagattcagtcctcttcttctgaaaaaaatgacatggatcgcggttccgagtattatgcagcagtcttttgtatcggtgggacagctctttgtacagggacgcatcaacagctttgggtctgtggtcgtggcaggatattcgggaggatttaaaatacagatttttatcctttcggtgcttggaactgtcggcaatgcagtttcaagctttacggcccagaatgcgggcgcgggaaaatgggagagaacaaaggaaggcaccaatgccgggattaaaatgattgtggctatggccgccgtattttctgttctctgtctggtcttcagccggcaggcaatggggctgtttctttccggaaactctgcagaggcagtcaggagcatgggagtgggagttgattttctaaggatcaatgctccgttcttcgcactggtcagtgtaaagtttgtatgcgacggcatgcttcggggaatgagtgaaatgaaaggattcatggcttctacatttgccgacctgatcgcgcgagtgtccctgtcctatgtgctgtcagttccgtttggggccacaggcatatgggctgcctggcccgtcggatgggtgatagggaccggcgtgtcggtgtggttcgggaaacgggctcagaaaaaatatttgaaataagcaaaaggccggttgtttccggccttttgtttcgttaaacagtatgttgtttttccaataggagaatatgtttttgtataaacttggcggtatctgccgcggaataaacttcgtcgctgtcggcaatgtattttaaataatcttttatggagacggccaggctctgctctgtcaaaaagaagggcttttccgtatgaaaaagtactttgttcgtcctggagtcggaaaaaatcctgaaactgctgctgagagtcagacagtccggtttcagcagcattggcgtatgtcggatcagttcctgcttggaacaaaattgtttcagggcagaaatactatcttcccgtttcagcggataaaaaaatttttttgaaaagccggacagataaccgctcttaaaaaaatctaaagctcctctttcggtgaagaagctgagaaagcctcccgagttttgtatcatatacctgagtttttccgcataggaaagcacagaatctacgataaattcataattgggagcatcctcccggaccatttctttcagcgcctggtctgagtagtaaggcaataaaaacggagaagctgaaagctccgcaagagtggcttttttgtttgagatactgtctttgggcctgtttttgcccgcagtgactttatactcatgaatgattaagtcttctgtacaggcgaacatttgatcaaagattgaagtatagagctttcgccggtttttgtttgctgagacatcggccagagtataatctgcagacaaggatacagtgcaatcggttgtcacgataaaaaacggcataacgttcatcctgttaatgtgggccggtatatcgtcataatagtattttacgcagtaggagccggaacgggacagcatcggatacatagaccgaaggctttctacgttatatgctaacttgtcagcctcagaacctgtctgaaggcagatgatctgagtgatctttgcatcggggcagcacaggattacagaggaaagcacctccattagaaaatggtaatccggctgggcgacgatctgaatacagccgtcttcttttgaacattcggcttctatgacagattttacaatgtgatttacatctgtttttccataataaactgaattggcgggcagtttgtgctgaaaaccgcagacgacagaatgactgtctgtgcttgaaatagaggagagaaatttttttactgcctggtactgcagaaaacgttcttctccaatagaagagattttataagcgttccacaaatcctctttttcagaaggagacaatcggaggccgttgaccagagggaccagcaggtctttctttctgggaagacgttctcctttttttattttggatatgtaactgacgtcaagatcactgaccgaagacaagtaaagcagtgtcaatctggattttttgatatagtgagtaagtttttcagaaaataatgacattgcttttctccttagttaaagttttctttcgtatgataactattatataaagaatacggaatgtttccaattctatgggaaaaaatacatgtgactatttggcaaaaaaagtgtcaaattctctggacatcatataaatatctatctgacattatacaaattctgggagatttcctggatgtgatataatgaaaaagagagaattcaggctgttgacttaagtttgcggaagaggaactttcgtggtaacgaaaaggaggacggaatatgatctcattttgtaatgatgccagggaattaaccagacaggtgattgaagaattcttttatgggaatccggaaaaggttcttcaaaattttcacccggacgtgacatggatcggagcagcaaacgggcagtgtatcagaggagctgaaaaggtttctcagtacatcagtcacatggaactgcccagatgtgaggtttttcaaaaggagtaccaggtagttgcacacagtgatgatatgtatgtggtagcaggctggatggagattggcgcttcacagggagaaagcgggaaattaagtgtggtacagcgcatcacttttatatggaaaaaagaagaagaccggctcaagctgctgcactttcatgtatcaaaccctgttgaatttcaggaaaacagtgaatacttcctcaggccggcgggaaagggaacatttgaatatgtaaaaaaattgtacagtcagaaacggcgtcttatcgcctgcggaaagcatgatcagacctatgttttatggaacaaggatattgtatatatagaagcggaaaacaccaacagcgtcattcactgccttaatcgggatatactttccagagaatccatttcaattttggaaaaaaagctgggagaagatttcataaaaacccacaggagttttattgtaaacagcaggtatattacagggattagaagataccagctggcggtcagacaggggattgaacttcccatccccgagaaaaaatacagggagatcaaagaaaaggttctgcgcgctgtcagtcagagacaaaatgaagtctgcacataaaatttagttattcacctgcactgaacagtcattggcagaatatgattgaaaatgtaacaaaatcccgatatagtcaaagacaagcattgtaacaaaactgcggggtctttaggaaaacagacgacatcaggatttgaacaggcagaaatatatcgtggtaaaaataaaaagatccttctatgctgagggatctttttgtttatttatggcgggggtgatcatgtggcagaagaaccaaaacttaaggcggcactccagacaggggtgcatatagcaggagagcctttccgttcatcgattgtctatggagaggaagggctttgtctgggtgcgggatgggaaaacgaaaatcatcacaagctgagcctgtcgggtgtcacggaaagtctgtcactgaatcttcctgaatttttgaactgggaaatggagcttagaagagcaggagtcttatacaaggcaggaaaacaagaaattttaatggagatcagcactgccgaaaacaggagacttctgtttgctgccaaaataaaagaaggaatttacagtctcagactatatcctgaaatctcctgcaggcttcacaacctgcccgtgatgggaaaatatttgggggagcaggatctgatcaaagtccgttatatgcaggccttataccagaaggaagggggattccgtggacagtgccttatagaggccagtttttcgggaagcgggtacaaattcggagatgaggacgttaagcttcctcagcaggacattgaagaacacaagtctttatctccggcagaagaaaagaaatccggcgtacactggatggaactgaacaaaaaaatcggcccttgtattgtaaaaagaatcggaggagcgtttcaggacggaacaatccgggtgtgtgtggacgcagggctgacgatctcggtactgacgcttgacttcatggagctttctctgggaatcaagcccggtccgaaatttgattttcagtttgggttaagaggcatggcagtgacggtgaaaaaacctccgctgatgatctcaggaggtttgtatgtggctgaacccggacggctctataacggggaagttacagttgcgtttgagaagttcacttttttagcccttggctcttacggattgacagaacagacagacaagccttcctttttcatatatcttatgctggactacgcgttcggaggatctccctgtttttatattaccggattatgtgcaggatttggactgaaccggaaaatcaacataccgcctctgtccggagttaaggactttccttttgtggcagcggccagaggcacgagtaaaactttaaagccgggaacaggagcttccgaggccctgaatactctgagtgaccatataaaaccgtgtgagggcatgaactttctgacggcggggattaaatttacatcctttggcatcgtagagtcggttgtgatcgttaacgtggaattcggaacgaagtttgaactctcccttctggggacatctgagatctcccttcctcccaaatgcagcgatccggttgtctacggatgcctgaatctgcgagcggtcttctcgccaggtgacgggattctgctgatcgagggagccatgtcaaatgactcttacctgttttgcagagatgccagactcaccggaggctttgctttttattcctggtttaagggagagtatgaaggagattttgtgttctctgtgggaggataccaccctcagtttcagagaggccattatccggaagtggaccgggtggggctgaactggaaaatcagcgatcatctggaactgatcggagaagcctattttgcactgacgccaaactgtctgatggctgggggaaaactggaacttaattatcatataggaaagcttgcggcctggtgtcatgcttatgcagactttctgatccagtggaagccgtttcactacgatatttccataggagtgagtgtgggagcgtcctaccgcctggaccttttgtttattcataagacttttaagatcgaactgggtgcggacctgcacttgtggggacctgaattttccggaaccgcacatataaaatggtttatcatctcttttactataaagttcaatacaggaagcccgaatcagccgccaaggcttaactggaagcagttttatacagaatttcttccggacttcagcggaggtataaaaggtgaagtttcttcctctgatattagtgaaaagagcaaagaaccgctgaaacttgcaagaatgaatcctcagggaggatatcttggagaaagggagaaaggagagctcaaataccattacataaatgcgaggcagtttcagatggaaattgagagcgccctgccggttgtgtctgcacaggtgaacaaaaagggtgaacagcttaaggacccgggatatgggatataccctatggggattacgggactccatgcttcgctggacgttcatctttacggatatcacgcggatggaacgatgtcggagacagcagtgaattaccggcccgtctgtaaaaatgttcccagggccctgtggaacagccgtcagccggatatgaaccaggacatgataaaggacgcatgcatgggactttctgtctggggcggggaaaagaccggacatttcataccgccggacaaagaaggaagaccggcgtggtatcggctggcacagctcttaaaaaatgaggtgtaccgctgtccggagcattttatatgggagaagaccaaaattatagagggaaaggattttacgggagaagagatggaggattccattgcaaaaaatgataagagaagtgaatggctcttggaattgaatgagtttggagtcagggcggaagaccagatccatatggatcattttgcagcacattttaaagaagtcttctcggcgccggtggaaatgaggagtacgggatgcaggagagataagaattaagggggtccggctatggaagtgagcatgaggtttgcagatgaagacctgcctgagataaagagcgggctttatgagctggaaataggattgaataccgggatcagagaaggcggtacggaaaagcagagcaaagagacgattcatctggtcgccgcggcaaaaagattttcgatggaccccggagaggtgtattctgtttatccggcggcagggagcgaaggggagttttcaaactgtcttccccatattgtgttcagccgggggactctgccgtgggagttcgggtgccgggacggaagcccggggctggctgtattcctctgtacggaggatgagggagtgaagaagcgtgcgatgaaaacggcagaggtttgctgtcagaaagaacagggtatttttgtttctgaacacctgcggttacagaacagcgatgccgaaaccggggatgaaacatgtgagattgtggatattcccctgaaattattccgccggctgtgcacagatccggaagagagaaaactgctcacccatgtaaggcaggtgaagcttgatgataaggtcacagatcctctggtcaaaaacgggacattttcctgcctggtgtccaacaggtatccgaaagagccggaggaaaaggggggtaagacttctcataaagtttatgtggtttctctgaaagagtatgaagggatcaccattcctgaaaatgcagaatttgtgcgtctgatctgtctgtatacatgggagtttgcagtcacaaaggaaccctgtgattttcgggcggctttgaagagaatttctcccggcgtgctgaaaagggcagtaaacccggaaggaaagccgggggaacttttggatattttaagccgggggtactgtccggtgaaccacgatgtcagggatggaagcaaaacggtttcctggtatcggggaccgtggattccatacggagagaagcagatgaaacccagataccggatattctcagatgaattttatttttatgaccccgactgcggaatgatggatgtgagttatgcatgcgcatggcagctgggacggatggtatccatgaatcatctgacggtgtgcagagagctggtttcctggagactggatcactgctcggaagcggcaaagaactttcagcagagccagcttcttgaccggattccggcagagggaaaagatgtgggggaacagctgataaacgcatgcgtccgggcggcgggacagctggcagccgggaaaggagatgaggacgatgggacgatggattcaggggaattgtgaccggaccggctattttgaggggctgggcaccgaagaatttccggaatcagtgctggaaatgttaaaagaggcaagcctgttttatcatgtgccggcggcgtacctgtttccggtgccggatatgctgaaaaaggacagcctgaacttttttcaggtggatcacaactgggtgctggcgatgctggacgggatctgcagtgtgggaaggaatgcgtccatcgattattcccacgacacagaactgatcgtggatatttaccgtcaggcattaagggaaaatgagcaggtgcgcctgaaactccaggatagagagtacatggatacaggagaacaagtcccggaagtgatcagtggatttttgctgaactccgtgttaacagaaaattttcggggattggaatttcgggcatatgaccagcgggagggaggagaacctttaaaggcgcttcggattgaaactctcgggcggcaggttcttctgggaatttttaagggagaaatacggcggcttgagatcgcgcagcctccggagggacttcattttgggttctttaccgaagacgggataattaagaaaacggtccgggacatcgaagagggaaagctgggcggcagacaggcagagcttgttttgaaatccaaagaaaacagggtgatcgatgtaaaggcctcggcggccagactgaaggaggcagcagggcttcagaatatgacatcggcggaatttgccctggagatgatacaaaacgcacagaccggagtatttacaatgggggaggaacttaaatgaggatttcagatgatcttgaagaaatgcgtctgctcccgatccatgtggaagccgccgtgtttggcagcggaaatgttcccatagctaacatcaatgaaaattaccggagtttgctggcagcgccgacgggagatgacatggagagcaaaacatttacggagaagagcagcacagaggagcccggggtacatctgcatttcattcttccggaggagtatacccacggaagccagcaggaggaaggcggggatatcgtctatccagaccttcccaaccggtggacggtgacaaggatcgcggttttggaaagcgaaggaaaggaaccggttttgagaagaaaaaactggattcttgagagtgatcttctatcggcgttcccagacagcgacaaacagtacacgtccatcggatatgatgatcccaaaaagccgtaccggtttctgggcaaaatgagagactgggacggggtggtgacttctcctggagagcacttttcacatctttcggcagtgagtacggggaaacctcatttcagcggatattatccggagtgtaaaaatgtccttggctgctatgatagtctctctgatcttgaggtcaaaaaggggacagaggattttgtcaggcttacttatattgtgtgcggctggacagagaatgacgcccccaaagatcatacggtgtgccatggaattgtcaccggaatcaaatggacgggtccttacggcagctatgagacagggatcccaagcggcaccaatatgcccaatgtggcggtggggaattcgctggaagaggcggcagcagccctcggaagctattatctgaagcagccggagatggaaaaagtgctgaagcatttgtttttcgggaccctgtccgattgggagaaacttgacggggctctggagggggagaagaaggtcaaacagtaccagttccgcccggaaccctccagggaagagcttaaaattcagggaaaagaagccggttgttttcgggaaagagaggagatcctttatgagatttcccgcagcagaaaacatcaggaggaatatgaggaacagatgaaagaaaaacggcaggagatctatctgctctggcgaaaatacgcgatggaccccaaatttcttgaaaaggcaaggagcggaatttcacagagaatggaagcggttactggtctggaaaagaaaagggaacatgaggaatttgtggagcaggaggcggtaaaaaaactcagagctctgcttggagacggggaagcgctgatcgaaacgcccggagagagatactggaggccgagagaccttacgttcctgctggaaggggcggaccagagcagcatctataagcggctggaaaaatataaaattgacggtaaaataccagagcgcaggcggaaagatctcatttccgaagtcatagtgaagatttccggagttacggagggggaagaagccaggatttcaggcgaacatcttttagagggaacggagcagatcagagagccggtcatagaacagcttgtacgggagggggtactgactgcccggggcagtattttctacacggcagacaagcttcttcgccggtataaaaaacagagagatacaaggctgatgtctcatacggtcacggcatatgaggactgtcttaacagacaagaaaatctatgcggggggacattggccagccccgttggaaattatatctggtgtccggcgtggaatcccctgatccttgagtggagcatgaagtattatcctgacccgaagataaaagagggggctttgggccttgagaactggaggcttagcgagacggattttgactatgaaggagaaaccatcggggaggaagtctttgagcctttcaccggcagatgtattttgtcgccatatgggtctgactatctgtcagggatgttcaaaaaatatgtctcagacgagaagtacagggatataggcaataagatggcgggaatgaagattttgtcacagaatctggacggttttcatgacaaactgatcaccagaaaggagagtgtggttgtggctccgtggatgaaccggacgttagatcaggaaatcacggcactgacttcccgggccgttcaggggacagagctttacgaggacctgaatcagtcgaagagaaaccagagaaagccggaggaggccttttatcctataagggctggtttcggaaagattgacagggtccgggtgatcgacagctttgggagggtgctgaagtacgatgtaggggatgtcatcgtgcctgagaaccttcgtatggggaaggataatcctgcaccgagatttctgctgagaccgagaattctggcgcctatgaggattcaaagccgctggattatggaggagacaggtatagtcgatgaactgtcaccggtttttggatggctgtgggtgaaccttttggattcctgtctgcacatctatcatccggacggcaccatggccggaagtattcaaaataccataaggatggacggcagcggcatgtatgaaatttctctgagaaatccgcctggacagacaagaaaagaagaggagattttagacgggatgggaccgagcctccggggatttgcggaagggcttttagaagccggcaggagagaaccgtccgcgctgccggaatttttaaaggctctcgatgacagtatgtggacaagcagatccggagggggtaccgccaaggagcagatccaggccggcatgggaaggcctctggctctggcaggaatcgagattggggtggatgtgaagggcagcagtcctgtgcctatgatttacgatgacagtgaaagggccgagtctctcctggaacggttttcgatccccctccgcatcggagatgaagtccgccagacagacggcactgcaggattttatctgcacggagagggcggcggattttctgtatttcatcagtgccggagagagaagggagcgaagagcaggacggcatatctggatcagaatacaacactgaacatgaaaaccgcaaaagacgctttgcctgcaagactgactgttttgtttcatccggcaggaaatatcagcatgacgacagggctgcttccggtcagggaaatgaagctcagtgaagcatggacagagcgggccatggagaatatttatcttacgttattttacggccctttcctgacgccgcaaagccagctgcagatgtttcttcccaaagctatggaaaaagaatggagttttttatccgttgaaaaaccgggaataaaaaatgaggaacgggacatcaagcctccgtggctggatacggaccaggaagaagagtggaaacagatcaaagaaggctggctgctgctgaaggccggtgtgcaagaaaaggggtgactgtggtggaaggaaaatttacatttgagactgtgggagaaaataaattgattgtttctgacagtcagatatctccggtcaaaaacaagctggagatcaaggtgacatttgatcaggatgaagaaccgctgatcagccagattgagtatgcgttcccggcgggggtgaaaagcactgattttgcggaaatgaagaacctcagacagatagaattcaaaatagatgactggactgtggtggatgtttcaaaagaagaatttatagagttgaaaaaacagaaaaaaaagcgaagcggaaatgtggggtggtatgcatgcaggtttgaggaggaagaaacatttacttatgctttaacaccgggcgaggcgtggacaatgaaagatcaacagattatggatctgaccatggaaaacgtggtgaccactgccgcagaaggtactgctgccatccggtgcacagtcgggattcttgcagaagatccgcaggaatatggactggaaataaaaaaagaacaggatcacacagtgaaggttcaggatttttatcccgagtcgggatgtgctctgtcgggagagcaggtcaggctcagctggtttgtccaaaacgcccaaaagctgtttttgtataccggagcgtcaaagaaggaaatcgatccggcaaagagcagtgagttagtgactgtttctgatacgacggaatatacgctggaagcagttaacggtgagaagaaggatacaagaaaaatttcgatccaggtactgccgctctgcctgagacagttttgggccgactatgaggaagaaaagattaagtgggacgtatgctgcggggatcacattaaaataaacggtatttccacaagctttgcatccgggtcggcgaatctcagtgagtatacgccgggacgccctgttgctctgaccgcagggggaaaaaatacatctgtggaaagtgctgtttactatggaacagaggatgagagaatggatgtcgtacatttccagaagaccattacattttataaaggctttcaaattttggatgtgctgtggaagctttatgaactgagaagtaataatacagccaaatccatccgcattgtttttcaggaccgtgaacgaaatgaactttacgacataaagggaggtgaggatctgggtacggagggaagctggcagcagatcttgacgggaacagacccggcaagggccggagagaatattttggtgacgatgtatgtagaaggctacgatgaaggtacaggaaaagagtatcagatcacgatttaagaaaggggaatgccatggaagtgaagttatttaagataaacggcactggcccgggtcagacatacgaggcggctgcaggagaacttctgaagattgaatgggattgtccgggctgcgatttctgtataatttatccatacaactggaaagttgactgtaatggagagatggaaatctatatttatgaaacaatgaccgtaattctcagagcagttaaggacagggagagtgtacaaaaagagattacagccaaactcagcgggggagaggatgttaaaggaatttctgtgtcccctgctggccctgctggttccggtgaggagacgaaatttgattttcagctgaccaaaactgcttttgggtatttggatcatggaatcggcagagttgaggggcgttcaggaagttatgtgttaaagaaccaatacaccgtatacagatacgatattctgacagccggcggagaaaccggatataaagaaaaaacggttaaggcgggaaggtcggatgcaccggaaatccagaggctcaaatatgtgatgatgaagaacggaaatgagcaaaaatatgagctatcgtggagggttgcgaacaatgatggaaaggacgtcatcatcgaggcgtcggatcacaagactacatttgccaaaaatgcttccgggcgcgcttcttttgccaggacaggcggagagactgtaacactttctgtccggtgcgatgcaggagaaaagggaaagattgaatttgcggacatctatccatttgaattgaaataaggaggttcatatggcttacgaaagtattacgatcggtacggaacaagaggtaaaagaagtatatctgtttctcgtcaatgaggatggttcgccggctgagatggaccaggacagcaagaccattgcttctatctggaatggcgaggagaagctcgtcgatgtaaccgcagatacaaggataacgattcccggattcgggacatgctttcagctggagcttgccaccacgcctgcaggaaaccatgaagcggatcggtggagaaaaagaaaagaagcgataaaactttttgtcagggaatttgttcctatgcagaaacatacaaaaaaaccggcggacgctgactttgcagtcagtgggaaacactatactgccggtgaattctcggcagagattcagggagaaggatcggagacgtataaaataaaaggaaaaccgggcgaccgaagaaaattttattttttccggaatgagtaccactccgttatccgatgtgccaatcagatgacaatcgggatcgggagagatgatcttacaagtgaatttttacagaaagcactttgggatcagcgaaaatgggatatgccatggatgaaagacctgtcggaagaacttgctgatccgctgggggctgtcagtcccacggcggagcagaaatttatgtacagttacgccggatcgatctttgactggtcagtaagactttatgtcaggcagcatccggatcacgagcatttttcagactttgacagaaatcacgcagatgaaaaaaacatgtggggtgtgcttcccaggtcaccggtatataagctggtgaattatttgaaagtaaatgaaaaaagtgtttttaactttctcagaagcagaaaatataatgacggaaacagtcctgaagaaacggcagagaatcgtatttacacagaactcgcagaggaattctggaatctttatgacagcggagacgggctttttgcggactttctgctccgggccggagtgatctccaatacgggtaatcagtatttgtttgaatttcgtaccgttaggacgaaaattgaaaatatttatgaggacagcagtcagtatatttacagagggtaagaaaggggtatattatgcgggaaatacagacggaactttttaaggggaaagaaaaagagatcctcgtcagtatatttggaggagagcagaaattaaaagaggaatacccggcattgtatgaagacatgagaacggcacaaaagcagtccggaaaccggaaggaagagggaaggacaagttcacaggatgccgattttgacggatgggaggaatttgaaaaattaaagctgttttatgatccaaagaaaaagatactgaccgtaaatggaaagatccataaatcgggcggacccgattatttgattgcaaagctgaaagtctggaatgggcagggaaaaacatggactttttcttattcggtaccacagtgcagctttcttatgatcaaggaaaatatacatatggaacaggacgaactgtccggaatacaggcagaaatcaattatatgttaagggttcctgacatctggaagccggttaagtcaggaaatatgaagggaaccgcggttattggtgcgggtttggatattatcgggaaaggccaggttcttcatccgcagcccaaagccgggagatccaagatcaacattgtttattttcgtacagatgccatgggtacatcggactacttttatgccaaccccgagagaaggaacagtaatttttgtgtttatctgccgattgccgtgcagtttgagctggacgcaggaaagcaggcggcccaagctcccagagtacagggagacatttatatttacagcgccagacattccacagtgcagtttcagaattttcagcagattaaattaatccccgcatctcagtggtacaacatgtttccatattatcctcagatatcgcagagctttacaaaaggatatctgttagttctgcctcaggcgtggaacagttttatcagccagggcggcgtggcaggggaagatgatttttatttatctatggatatagagttttcatgtacagacgggtatcgatattctttgcagatggacagctatttggttcctaaaaaatatgagggaggcaatgttgtagagatcccatgtatgcacctgctctggggctgccttgaaaaagaagctgtgatcaaaacaagggaccggggcagtataccggtgtgcgatgtaaagagtggggattatgtggcttctgccaagggaaattatgaaaaggtcagcaatatttatactggaaatgaagaaattttgaaatatataaaggctggagaaaaaactatcatgatgacaatggaccatccggtcatgacaaaggaaggatggaaacaggcaggggaactcactgggtcagaacagatctgtatggatggagaactgtacagtccggtggatgaggtttatgacgagccttattatgaccgggtatattctttggaactggaagatggagaaggtttttttgccaatggtttttatgtgggagacttcggaaagcaaaacagtatggagaagccggaaccgaagctttcacaggatatcctgaatgatttagagaagtttaaaaatttatcataaaagagaaaggagaaacattatgccagatccaaaagaaccaagcgaggtagtgccaaaggaaccggaaatagttatggaaggagggacggggaccagtgtggcgattcctgtacgcatcaatgcgggagtgaaatttacgctgctgaaaaatcattttgtggcggcgcttgaaaaagatggggacgtcatgatgctcctgctggcgccgacggattctgccggccaggagggaatgaccatacaggagatggtggaagaagtcaggaaattgatgggtgccaaagaaggagataaagaggttgcggatatggagactcagctgaatagtaccgtgaacagtatgagcgatcctaagaaagcaggcggcggctttaatccaatgtctatccgtatctatgtacagcaggcgtttttgtattaccgttctgctaaaaaggaggatggaacagaggaaaaagagctggaatatgctttcagcctgaaagcggatacttctaagcttcttggaagtatagacttattcactctcgatgagatctatttttccgtgtggaagacaaaccgtaaaaaagtcacagacacgatgaacatgtttatgattgaagacttcttgaaggagacggcacaggcctgagactaaaaagccaggtatgccgcgtgagtcagaaaaagcctgcatatacaggctttttttgcttcttatttcttgattttattagaatactgggcttttactaaatatacaccggcaatcacaatggcaattcccaggacttcccttagagaaagaacttcggaaaaaataaaataagaataaagtgaggcgatgaccggctggcataaacatacgatcgaggaaaggttcacactgagctttccctggcagtgggccagcaggttatgtccgatgacctgaaggcagagggtcagtcccaatagcggccagagctgctctgtcccatggggaatctggatgccctctgttaaaactgaggtgacccccaatgcaagggcacttccgaacccgcttacaaacatgatgacactgctttcgtatctgtctcttaaacgataggagatcaggataaaaaccgcatagaaaaaagaagcactaaaggcgagaaaatctccaaaatagtttgactggagtgggctgatctttccgcccaataaaacaaagactccgattaaggttaccgcagctcctgctaaaaataacttcggtatcttttcccggaataaaaagtatgagaccggtatcacagtaaaaggcgtcagatttgtaagtaagtttgcatttgctacggatgtatagctgaaagataggttccacaatgctacatcaccggcgaggaaaactccggccagaaataaaatgagtacatcctttttggttaaaatgcgcaggcccctgaacgccagaggcagcagcagagggagtgaaaaaagaactctgtaaaacccggtgctgacaggagtcagtgagctgagttttacaaaaatgcctcctgctgcaaggaatgcaactgctaagagctcaagcagtacatattttgtttcgttgttccgttttataatcttcaagagtctgtcctccgtctgtgcaggtttcctttgtgtttaaaacatgatacacttacactggaactatgaaaagacccactatatactaaaaaaatagtaccaccgggagagggatttcatgattattcttgacagaaaaaacaatgaacctttgtatatgcagatttatgcacaaataaaagaggaaatattaaacggcattatcaaggaaggtcaggtattaaccggcagcagggggttagccggtatcctgggggttagccggaatacggtaaacagtgcttatggccagctggccgcggagggatatatcataccgcagaaagggattggatatactgccgcaaaggttccggaacttactgtcagcagggagagaccggttcaggcccgtttaaaacaagcgatgcctgtggaaagaaaacagcctgacattctgtacgatttgacaaacagcagtcagacaagcgatctgtttccgaagagattttggaaacgctgtacgttagaatgcctggatatgctggaaaacgaggccagaatatcatcctgtcaggataagcagggagaattatacctgagaaaaaatctgctgtcttatctgcagcggatcagaggtgtttcctgtgacgaagatcaaatcattatcacatgtgggatacagcagtctttagactatctctgcaggctgttcccgcctggaaggcagacgattctgatggaggaaccgggatttcataaagcggcagcggtattttctaataacaatataaatgtgcagaaggttcctgtggatgaacatggaatcgtagtatccaagcttccacgtgtgtctgatgcctgcgccgtttactcaactccgtcccatcagtttccaaccggtgtcaccttatccgccggccgccggtatgaacttcttgaatgggcgcagaagaatgatgcctttattatggaagatgactttgacagcgagtttcgatattactcaaaacctattccggcgctgcagtccatagacagagatgaccgtgtcatctaccttggaacattttcaaaagcgctttccccttcagtgcgcatgggatatatgatattgcctccaaagctgctgaaagcttattttcacaggtttgaaaattacaacagtacggttccgctccttaatcagtatgtcattgcacgtttgatagaaacgggtcaatatgaccgccatgtcaggaggctgaaccatatattccgcaggcggctggaacgtttttcagaagaattagccgatgtaaaagacaggattgaaatatccggaaacggtaccggacaatatttcctcttaaagtttgccgggcaggctgatcaaaatgagttaataagaaaagcacttgagcgtggggtaaaagtgtatccgaccatgcagttttggcaggaaaaggctgcctgtccgcccaattctctgtttctaggctttgccaaaatttctttagaggatattcctgattgtgtggaacggctgagagcagcgtggaaagaatggatttaatggcagattccatctttgatcaaaaaataaatataaagttgctggaattatattcataaaaggaatataatataaccataatgtaatcagtttataatcaaaaggagaatgctatggcggtaaaggaaaaaggttgtttttattgtgacccggaccatcaggggcgaaaggatctgatgatcgaagtggggcagatgaaggagggggttttatacctgtttaaagatcaggctcatttaggacgctgtgtagtcgcagtgccggagcataagagtgagctgtttgacctggaaccaaaacagagacatgattacatagatgatgtagcggcagctgcaagagctataaaaaaactctggggatgtacaaagatcaactacggcgcttacggggacaagctgcctcacctgcattttcatctggttcccaaatatgagggcggatttgagttcggaggagcttttgccattggaaatgatgaaccaaaatttctcgccgatgaagaatatgagacaatgatcggtcagcttaaaaaggaattaaatataaaataatgagtgatgctgaacagattccggtgaaagggttctgttcagctgttttatttcataggaaaattgaagtggtcctgcccgcgttgttccgccacaggaaagttcgtgcgggtacacgggcttgtaggcaaaagcggaatcacttatactggtagatagaaactgcgagggaggcgggaatcttatgcagaagtgttatactaccggtgaatttgccaaaagggcgaaagtgaccatccggacgataaggtattatgataaaaaaggtatcttacagcccagcttccgcaatgatgcgggatataggatgtatactgatcaggactttttaaaactccaaaaggtgctgtctttaaaatatctgggattttcgttggaagagatcaaaaatatgacaatcaacgatgatgtatcagatattacaaaatcgcttcagatgcaggcggacttgcttcataaaaaagcagagcatttgaagctgatggaagaagctttgcgaaagacgacaaaaataattgaagagaccagcgaggtagactggaatgagattctcggcctgatccatatgacgagtatggagcggactctggtagaacactatcaaaactccacaaacctggatatcagaatcagcctgcatgacaggttttctgtaaataaacaggggtggttcccgtggcttttttctcttgtggatttcaaggatgcggatacagtgcttgaggtcggctgcggcaatggacagatgtggaaaaatgaacaaacaaaagaattgtcaggtatgaaagtcatactatcggatatctcggaagggatgttgtctgatgcccaaaagaatcttggaggggtgaggggacctgattttttatttcggaggtttgactgccagaacataccgttttctgataagaccattgaccgggttattgccaatcatgtgctgttttatgttggcagtcttcaaaaggcactagaggaaatatgcagagtgatgaaagatgacgggattttttactgcagcgcttatggaaaagagcatatgaaggaagtcacgatgctggtccaggagtttgatccgcgcattagtctgtcggaagtaaatctttttgatatgtttggcctggaggaaggggaagctgttcttaaaaggtattttgcggatgtgaaaaagatagggtatgaggatgctttaatcgttaccgaggcagagcctctgctggattatattctttcctgtcatgggaaccagaatgagatattaaataaccgccagatggaatttaagaagtttctgaaaaagaaaatagatacacagggacaagtaaaaattacaaagcaggctggtgtatttgtgtcaaagaaagagaaatgacaagaaaatagatggaaataaaaggaggatcgatggtttacaataagctaaaataatgttatattaaagataaagaaaggagcaaactgcccacgttggtggttagcctcttgggtataaaataaacctaccttgactggctaagtacaaaggtaggtttatttatttgcgcttgtttttcctatcaatataggcaagcagtgccaaaatgaacattccaaacgttatcattaaagataaagcctcatatgtagtcatcagcaccacctcccctctttatcaaaagttgggaggctaccaccttgtacacagattgctccgtctaaacatcataacattttctgtatttaaaaacaatatatttacaataaagaagatatttagaatatagaatcaagccttgacggttacgttacgtcacccattataatgacactaactgataacggacaaagagaaagggaatattcattatgaaaggaattattttagcaggcggttccgggacaaggctgtatccgctgaccatggttacgtcaaagcagctgcttcccatctatgacaagccgatgatctactatccgctgtctgtgctcatggacgcaggcatccgggagattctgatcatttccactccagacgacacaccccggtttgaggcgcttttaggagacgggcatcagtttggaatcgagctttcctatgaggttcagccttcaccagacgggcttgcacaggcatttatcattggagaagaatttatcggtgatgataatgtggcgatggttctgggggacaatattttccacggacacgggcttaggaaacgtcttcaggcggcagccaacaagaagagtggggctacggtattcggctattatgtagatgacccggagaggttcggcatcgtggagtttgactctgacggaaaagccatttccatagaagagaagccggaacatccaaagtccaattactgtgtgacgggactgtatttttatgacaacagggttgtagagtatgcaaagaaccttgcaccttcggacagaggtgagttagagattacagatttgaataaaatctatctggaaaatggagaactggaagttaccctgcttggacagggattcacatggctggacacggggacacatgaatctctcgtggaggcgaccaactttgtcaaaacagtggagacacaccagcacaggaagattgcatgcccggaggagattgcatatcttcagcactggatcaccagggaccagctgttaaaagacattgagcctctgaaaaagaaccagtacggacagtacctcttagacgttatgaatggaaagtatatagacaagtaagacaggagaaaacatttatgaagattttagtgaccggcggcgccggatttatcggagggaattttgtgcatcatatggtgaacaaataccccaacgatgagattgtgaatctggacctgctcacctatgcggggaatttagaaacattaaaaccagttgaggataaaccgaactacaagtttgtaaaaggtgacattgcagatgaagcatttatcatggacctgtttgaaaaagaacaatttgacatggtcgtaaactttgcggcggagagccatgtagaccgctccatcacggatcccggtatttttgtgaccaccaatgtgatgggaacgagagtgcttctggatgcctcaaaaaaatatggggtaaaacggtatcaccaggtatcgacggatgaagtgtacggggatcttcctctggaccgtccggacttattttttacagaggatacacctctccacacctccagtccatacagcagttccaaggccagcgcagatctgtttgtcctggcttattaccgcacatacggactgccagtgacgatttccaggtgttccaacaactatggaccgtatcatttcccggaaaagctgattccgcttattataagcagggcgctggcagatgaggaactgccggtatacggaaaaggagagaacgtcagagactggctccatgtgtctgatcactgtgaggccatcgatctgatcctccataaaggaaaaccgggagaagtctacaatgtaggcggacacaacgagcgcacaaaccttgaggtcgtgcagaccatactgaaagcactggataagccggaaagcctgatcaaatttgtgacagaccgcccgggacatgatatgcgctatgccatcgacccggcaaagatagagacagagcttggatggaagccaaagtatacatttgataccggaattcgtcagacaattgaatggtatctgaacaacaaagaatggtggcagaatattttgtccggtgaatatgcaaactattttgagaaccaatacggaaaaaggttagaacaggagcaggtatgaagatattagtcacaggggcagccggacagctgggccatgatgtcatggacgaactgaaaaagagaggccatgaagggatcggtgtggatgtgcaggaaatggacatcacagacgccgaaaaagtacggcaggtgataacggctgcagatgtggatgcagtaatccactgtgcggcttacactgcggtggatgcggcagaagacaatgcagaactgtgcaggaagatcaatgcggacggcactgaacatatagcccgtgtatgccgtgatctggatcttaagatgatgtacatcagcacagattatgtgtttgacggacagggagaaagaccgtgggatccggatgatgagaggaatccgctgaacgtatatgggcagacaaagtacgagggagaacttgccattgaacagaatctggacaagttttttattgtgaggattgcctgggtgttcggagtcaacggtaaaaattttatcaagacaatgctgaacctggctaaaaatcatgacaggcttaccgtggtgaacgatcagaccggatctcctacttatacttatgatctggcaaggcttttagcagatatgatagagacagataaatatggcagatatcacgctacaaatgaaggactttgcacctggtatgaatttgcctgtgaaatatttaagcaggcgggcatcgaaatcgaagtagctccggtgggcagcgatgagtatccggccaaggcaaaaagaccggaaaacagccggatgagtaaggacaaacttacacaaaacggttttgaaaggctgccggcatggcaggatgctcttgccagatatttaaaagaaatcgggtattaggaggaacagatgggaaagattaaggttacaaattgtgagattgaaggactgcatatcattgagccggcagtgttcccggatgaacggggatatttcatggagacatataaccaaaaggattttgaagaggcagggcttggcatgacctttgtacaggataatcagtccatgtcggtaaaaggagttttaagagggcttcattttcagaagcagtatccacagggaaagctggtgcgcgtcgttcgtggtaaggtatttgatgtggcggtggacctgagaaaagactctcaaacttacggaaagtggtttggggtagaattatccgcagagaataaaaagcagttttatattccggaaggatttgcccatggcttcctcgtcctctcagaggaggcagaattttgttataagtgtacagacttttatcaccctggagatgaaggcgggatcaagtgggatgatcctgacatcggcattgaatggccatttgaggagggtacggaattggtgatctcagagaaagaccagaaatggtccggattaaaagacacttttaagttttaaaagacatttgttatcatagcggtatgataggaaatatagacaaaaatatagaaaggccgatgtatgggctaaccatcctgtacattggcttttttattatattttttggggttttaacaaagtagagtgtaaaataaatcatcttaaaattctgtacatagtgcacaaataaaaggcggaattgttattaaattgacaaaactttgacattataattgacattatctttcgatgggcatacaatcaaggggaattaatatgttctatatcaatctgtgggttagatgaaacacagattttttgcatttatatcaaaataaaataaggggcattagtccgtagggggaacggagttatgaaaaaacgcattaggcagatcatttctatcattctgtcacttttaatggtggtacagagtccaaatttttcagcaattattaaaaatgtaaaagcagatgagtcgccggggctgcaggtcagcttttcctgtaagcaggagccggggaccaatgttacgatgcttaaaaacggggcatctgaagaactgacaggacaggtcaatgtcacagccacgtcttccggctatgcaaaaggagcaaaagtcaccgtcgcattgccgtcttttttctatgacagcgacggaaatctccaggtttatgatgagaatgtcaatccggaggatgtaaagcttggaatgcaggccaacgtcatagaggcggacagctggcagacagtggagggaaaggcatttgaccaggacacagtttataaaggcaagatcgtatttgtagcaagcaatgacctgaaggccggggaatctctgaccttccgtattaaggtgaagtttttcggagatgtgcctgagaaaacacagggaaagattaccggaagctcatcttaccaggagtactacgataagaacggcaataagatcgcggacgaatggaaatctcccggggtagatgaaaatgcaattaaagtgtttgtaaacacgaatctttcatgggagacggtgtttgaagactcccctgccattccggtatggaaagagtataattatgccgatcactatgttacagttaaaaacacctcagagtcagaggataaggacggtccgaaagatgtttcatttgataagatcaacctgatgtttgagcttccgttctgctcctccgaaggcggggtagacgggatctttacacgggatatcacaaaatggatttataaagacgggcagatcatcgaaaatacagagccgaacaatccaaattcatggaagaacacggagtttatcgggaaagaggataagggaggtgttctcgtctacgatgtcacagatctgacagatgaagagatcaaagatgggaagcttggaaaacctatcccttattcttataccggaaacggtcagattgcagtcattcatgaagaagaaatacactctccaaactacgcaaaagaacacccggataaaaacctgcaccaccaggctaagtttctggtaaggctgccgttcacaaacaatattcagtttaagggcagcagcacgaccaacgaacttcagacgaagctggtatccacgattatttttggaaaaccggagatttactggtctaagacaaatacagctacggctacctttatgaagccgcagccggattactctgcgaaaaaagtttcagaatcagaagctccgtataataaacacgtttatgtaaacagcttatccgaattttatatagagagcattacaaataaagggaatatcccgctgttttcaccgagagtgacagatacggtgccgggtcagtttatgttggacggactgttttatgaggttccgaaaaaagatgcagacggcggaatagaaaagtttctggcgaaggagcatccgttccagtatgaggttaccaattccgctacaggagaaaagcaatggattgactttacccagagtgtgacagagaagagtaccgatgatgaagtgaggtggggaatctcaggaattaaaggcaggcttcccggcaatgccacgggaagagtccgtgtgaatctgaaagaaaagatagatgccggaactacactgccaggcaagatcgtgatcagcggttatcccaaaaacaacgttacgattcagaataaagcagaaatccagtttgactacaaatactacaaagttggcgacggtgatacggaaggcgaatggatggtcaaggagcaggagccgtacaagatccaggcagatatggtactgactcctcctgaaatcgacactgtcgtcacagcagtacatacagaaaagaaagaaggggaaagccaggcagcagtgaccgaaggcggtagcagccggtcaccgtatcatcagacagtatacggaaaatacaaccgccagggcatggacgggtatattctgagggcaggaacccagtcaaaagggccgatcgcgcccggatatcttcagctggatgtaccgggagctgccaatgacagaggatatgtgacagaaaatatcctgctgaaaaaggatcttctggatgccatgatcaatgtctctgtgggaacgagcgaagaagatcagcaatatccgtccggaaatctcattcttaaagatgtgaataaccagacaaagaaaatctctttgaagacgctcgttcagggctacgcagacggcgacggaaatgtggtgattgaacgcagtctgtggaagggcgatttagataaccttaaaagtgtaaggattgaatacgactattttgccggagaccagaaaattgtaaacggagatgaactggctgcggagacctatctgaaggttatgggaacgttaaaggattatggttcccttaccgccaccggtacagtttccacaaactatccggggacatccacgagctctgtgacaaagacagggacagggacgatcacgattgaaggggtgaatccggccatcacaggaaatgtctacaatgagccggatcatccgcaggcatccaatctgacatccattacggtgccatataatgaagacagtgctaaggctgtgttccatataggtaataagtcacactcagaaatgaaccccggggaatttctgatgacgttgccgacaaatgtggtcgatgaaaagacggtgggattcctggcagatgagatcaccatcaaagatttgaaaaaattcggaaagatttcaaaaatagaattttatgatatttccaacaacacttatgcaggaaactccaaggagccggattttgttctcccggcggatcagatcccggcagaaaaagacggattgattacgattcctgagagtttgtggaaaagttctatggcaaacggactgaaatatgtaaggattatatttgagccgtttaacggaatggaaactgcggagaaactggacatcaccgtaggcggaaccgcagacttttacggcgcggcttctttcaggggtgaatgggcatgcaaagatgcgctgaacatgaacaaacctgctcagacagcgggcatgacaatgaatgtcaataatccgaagcctgaagtgaatgcacatttaaatccatactatgataagacagagatcaatacagaaaacaacggcagtatggtggacggcaatgtgatggggcttgcggttccttatgaaaaggaagcttccttttccttctggtttggaaacagtgcggcaaatgatgcacatgatttccatacggtgatcgattttacggaattaaattccgccaaccagctttctgccgagacaggaaaaggtttttatgcaaagtctgtactgatcaggaaagagcttctggatattgccgatgtcaaagaaattacagtgacaggttccgaaggcagcttaactcttgtctatgacaaggatgccaaaacattcaaagaaaagggccagccttccaagacctatactttagaaggagagggctggaaacttccgaaaagcagcgttaaggatctgggaattcttagcgggatcgaggtgaccggagggacaatgaaaggcgggaaggtgccgaaagcgtcacagtccatcgaagtaaccggattttccgacattgaaatgcgcaaggttaatcaggcggctgcaaaaattacgagcaaactctataccaccgacaggtcctttgaacttacgaatcaggatgcggcaaggctgatgatcagcccgatgtattttgatacggtcgtagacgcacaatttgtaacgccggataataaaacaaccagatataataatggtgcagagccttccgagcattaccgttcaagctatggatacagtgatgatacgaatcttgagatcggctataaagcggtcggcagtatcggagtcgatttccgacagtacctgcaggattacagcagcgggcccccggaaagacacaataatcaggagcagtataatgattctgcatacagcagatatcagataaagaattatgcctacaatacaccggcagatctgaagatgacagtgaatcttccgtctgagggctttgagacatactatctgaaagtggatccgagagtaaaggactatgtaaaagagattaaattataccgtgctgatggatcttcctatacgatcgatgatccgaaggcggtctgggctgccaatgaaaatgccaagagctgggacggacagaatggatattggagaatcaatcttctggacggggagccgaattacgaggcagaaaaagaagggaactactaccgtcatccaaaagaagagccggacgggaaagaggcggtcaaaaaagcagagattcgtttttctgttaaccagcaggaatacgaggagatcggaggcgtaaaaactgccaaatcaccggattacggcacatggtataaccaaagcaatgtaaatacacaaaataccttcgaatttgtgggaaggtattataaacttggaaattataaggcctctgcagagacagaaatgacgatcggcggcactgaaaaacctgacggaacgaaaaccgaaataaaaactgaaaatacagacactacgaagaacagcagctaccgttccggctggtcatttaaaaactactattatacatatgactggtatggaagttataccggttcacaggaatacacagcaagacatatgagatcggaagtgccgatcactgtctatgacgatgcaagaatgtactctctaaaaggagtcaacctgcatcccgagacggacagaaaagagtcctatccatatggtgcaaccggatgttacagcatgtctttctaccgggacaaaaccggggcttccggaaactggagcggctattatccgtatatcgacaatgcggtgctggaagacacacttcctccgatcacaaaaagtgacggggagtataaaggatttaagagtacgtctgttcagatcaagaaaaaactgctgaaccggacagacggggatattatgctgacgctttccgacggaagcacagtaaaaagagcagcagcggatttcagcgatgcagcagacgcagattataaagagatcagggtgttttatgaaggagaggacaacgcgggagaagctgtggacggaaaagatatcgttctgaattccggacagtatcttacgaaggttaaattgtttgtcaaggacattgccggtgacggtgatttcagcaagactgagatcgacggaatatccaaagacacggtatttgacaaccgcacggaaccgatgatcaacatctacggtgaaatactggcgctgaacggcgacggaaataatgccggagtcaatacggttaacaccaagacgtttaaagactatgatccggtcaatacagtaatcgaaggaaacacagagacgggtactctgctggcaagaaggattcctttgaagccgggttataagctgactgccaacaatacaaaaggatgggattatcaggcatccaaacttgatgccggtaaaccggaaatgaagccggagtcttcagcgtttaccatccatctggaaaacgccggtacagacgacggaggcagcgatcctgccaactctgaatccagggacgcagatatcagcggttttgcctttgaccaggctcttgacagccggttccggcttcagacaattaagattccgaaaagtgtctttgactctgacaagtggaatgtgactcagttcaagatcaatgacggaacccactccggtgatgataaaggagtggacgtaaaagacaagtttaggctggagacaatcaatgatgaagaatactatgttttagatgtctccaaactattcgtgggggacgatgccttaaatacatccacctatacaataagtggtacagaatttacaaaatgttatatccaaagttttactgtaaaaattgaggccaaggaaaccgatggaaacaagaatgaaaaattcctgagaccgggccaggcattagaggatattatctacgacggaatctttgtggaccggacaaaagaagatttggaaaaggatgagtggaacgagaattctgtgcctaccataggaggaagcggtacacatgattatttctacacttattacatccgaaacagcattcagaattttaaggcagaatcagctacattcggttatcagcagagtacgataactgccgctccccatgccgatcaaacagtttataacagagtttcccatgtggaaatgaaacagaagcgggaggatgaagagacgaaatctcctgcgtatgatgaaaaagacggaataaaactggaggtagataaggatcatatcattccaggcgacagaattgaatatcaggtgacggtttccaacaaatccgaaaaggagtctgacggttctgagacgaatacgccgtttaaaaatccggcggttcgggtgacggcacctgtaggaatgaagatcgtgggatggaagtatgcgaaaaagacagattcgggcattggagatctgaagggtgaatttgtagacaacagcagttctgtatcaacgaggacacctgtggtaaatggtgcactggaggcaccggaatcaaaaaatacataccggaatctggtgattacaaccgatacagatcatggagaccagtatctgaaactgaacaaagactatactgtgactgttgttctggaggcgaaggatgaattttccggagcatttgaaggaaaaacagtgaatacaagcgtctatgcgggaggcggtcagagaaatcactattacccatattatttcggaaacagagacacgaatccgacctattcttactcctcatggtgcagcgatgcgtttggaagcgccagtttcattaaacgctgtgtggaaaacagctctgccgtcgatctggcactgaataatacacctgtgccgacaggagagcttacaagttctgtttcttatatggatgcgggaacacctgcaatgaagttttccaatccatcttctgtggaagggggaacggcatgggtcaatgatttgatggatgtagatctgacggtttccgacattaaaaacaatacgatgcatgatcttaaggaaacaggaattgaaattgacctctccaaccagacagtaaaaaatgaacagaatttctacctcagaaaatggccggaggcaaaatatacggttgcgggaacagaacatcaggctgtcttttactataaagaagacggggacacacactggaaagccatggatgcgtccttccggtctgatgacagcaacctgaaaaaagtaaagcagatcaaatgggtctacgaggatgttcctgccaaagatggtacaaatatttataaaatgccggatgtcattcttcatggaacggcgaactacgtggatgaaaacggagcatcttctgtcaaccaaaattacagtacaatgaatggtattctggatattgactatggccatgaacactataaagtgtcagatgatgacaagatggaagcccatctgctggcagatacaaagaatacatttaccgtataccggctgctgccgaatatgctggcagacgtccaggcgtttgacaaagaagaagacgcaaagagcgcctatgctgaaaataacagcaaaaacaaagcagtgtaccgaccgaatgaaagtttttggtataaattgactgcctggaacaagcgcacagacgacagtgccagaagaggggcccttgatcatccggtgctctatgacaagattccggaatatgtagatgcaccaaatccggatgatgttgaaatcatatggtatgacaaggacggacatgcgaaggattcttcagcttaccaaaaaccagcagtcacggtgactgacatgaaagattttgatatcggaggaagtcaggaatttgaaaaagtgacttcaggcacagacaggaagccgacagatacagcgaacaatcctgcagaggaaattaactttaagatctacaaatacgacttcggtgatcaggagctgtccagaggcgaacggatcgagatcgtctataagaccaaggcgagaaaagaagacctgccgatggcatcatggaaggatacaaaagaaaacgcataccttccgcgctatggagaatatgcagacggtcctgcgccgaatgcaaacaatacagccgcaaaagctatggatatggataatctgatccatgatttcggagttaccggaacacccggaaaaggcattgatccgggagaattcctgacggattcttatgcatatattccgggccagacgaccagtgacggaggcagattttttgattatgatatcaattcttcttccaggcagatgtgtttcacaaatatgactgtgacagacccgtccaaagaggcctcagctgtatcctaccgcaccggtgccggagggggaggcacggacagtgcctattacaggtatctcacatccggaagggtcgtatccggaacgggctctgccaatatgaataaatggaagaacatcattggtgatgaataccacaatattatctgggcagaacatgcactgcatctgcagaaagcgtggattaccggaagcagtgatatgataacggatcaaaaatactacgatcaggcagatatcaattattccggcggttccggacacagagatgacgttccaaactacgaccagcagactgcggcattggaagctgaagaaaactatgtaacaaggctttatgcgctgaactatggagactgggacacagacggagcggagtttacttacgtgatgccaagaggtacaagaccagtgctgaaagacggcagacttgaagtgaaggccgaaatgaaggacggtacaaagattactgttccagaagaaaatattaagatacttcagcagccgggagatacggatatcggcgctcttgcgccgaaagaactggcagaccctgtgcataacggagcatataccggaaaaacatataatgcagcagatgcagattcaaaagcatgggtgatccgaattacagtaccggagaaacttacgcggttctggaacagaggaagtctggatgcatccaaacagcagcattaccagatgtctgtagaatttaaatccgaagtgttcaaagagaacatgaatgaaatgtggtatgaccgtctgtatgtgcggccggtcgatatagaatccaaggacagcgaagttccgaatacgatgtatcaccagatttatgacaagaacgacagcatggatatgtccgaggcaaacaaaagcggaactgttcagtgcaatgatttggaaaccggtatttggtattgctcatactgtaatacagaagcctactataatctgctctcaccgtggcctctttacctgaagggaaggaatacttattctcaggcagtggacagaaaagatataggatttaacattgaagcttcagacggaagtacagactccaccaaatatgcggtcaccggaacgagggcaaaacagaggaaacctttggtccgtttctgggcggaatacggcaggagggatgaaaatgacgtcctcagtgctgaccagtggtatgctcaggcagagacagaggtgaaacagctgaatgtccgcctggaaaatgagtatatcctgtcagactatcaccacggaaacggaagcggtgccgacagcggaagaagctataactacactacgaacggaggagccaggggaaccctgtttaaaccggttgtgaccgttgtgcttccttatggcgtacagcctgtggatgaagacggtgaagtgattcatgcagattctgatgaatcagttgtacagaactttgactgggaaatggaacagaaagtctggtcttccggaggcagactggctgccgacacagatccggacctgccggctgatttaaaatccaagtttgacacagagatccggtatatggatgtggatgacgacggaacagcggcaaaacggtatgtgatccggtttgttccgaaagcaggaacctccacagaggatgtcagagtgctctcaggacggtccagaaacataaaaatgaatgtaattgcagcagattacgccggaaactggccggatgatgcggataagacaaaggattgggacagcacgagagtctacctgggaagccagcataatcttttccgatatatcacggacgaacagatcggcggcgaaaacgcaggctatgcggtcggcgtggacacaaatcagggctattataatcaggacccgcgtctggatgcagtcagcccggattatacgtacagcacgtaccgcacaggaaaaaccatatatgacaacaaggcgatggcagacagggcgattggccggatgactccttattttgaaggcgacaagatcagtcttcaggatacaggactggcagattccctgctgttctggcagaccggaaacggagaagacaaatacacagaccttaactatgatggaaagaaagaaactggggacggcgcggaagaagccgtgcttcaggatcatggagtcatgaatacagcaagtctgtattcgaaaaatccgagaatcagtctgaccgcaggcatttccggcagcagaacaggaacatattattccgcagagccggaaaataacactggaagcccggcaaaactggctccgatccagtttgcctatggcgacaatctgtggtatcagctgaaagcggccaatactccggctgagaggtcagggtactggggaccgctgactgattacggtacaacaggggatataacacattcagcctttacggttaatcacacgctcccgaaagcactggtctatgatgacagcggcgatctggaaagttactatatcgaatatgtggaccgggacggcatcaaacagaccttgaaccagtcagatctggaaagcagtgatccgtccaaaaacaaaggctggaaaatacagctggaagtaaaaaaggtgaaagacaaggacggaaactatgatcaccaggaaattctggcgaatattattccgggacaggaagcagatgttacttccgggaatatccataaaggaaagctgccgtcaggagcgcttagatcgggcaaagactttacactgtttttgagatccaggattgcagagcttccggaaccggaagatattctgaaagatccggattactggcagtataattcagagtccagctaccttgatcttcaccgcatggacggagacttcgtgccgggcggtaatttcaaagagcgtccaatcgagacggtcagctacacaaaccaggtgaaagacagccaggaaaatgattatgacttcgacggaatcttcgatgagcggtacagcatggcaaaggctgccggaatcagagtgacaaaaccttcggtttctatgcgcacagacacaaaagacccaaggagaatttaccaaaaggatgacatcactcaggatatccggtcttccgatgcactctataagacaaaagacgtatttaccttactggtcgatgaggctactgtgcataagggcaacctcaatcagttcatcgtccagtataagattccaaaccgggctccgaacactgtgaaaaacggaccggcagagccgactgatccaaggatcgctgtctctgtcaagcgggtccagacaggaaaatgggagattccggccgatacgaagtgtaatgttgatattggcgaactcagaaaacacctgagagtttatgtagaagtcctggatattgacagcggaagctctaacgtcacagacgagaccgacaaagatatgaactgggtgcgcctgaatccggacggagcaaaaattgatgaaaaccaggtgatcgaactgacgggggctctcaaaaaatattctgaaaaaggagccgtcgacgagatgcgctggatcgtcacttccgacgatccggcacactatccggtacctcaggggttccggctggatctggatgcggatgacagtactgcagacaaagaagatgtctctgccgtagaaaagaagaaagcagaaaacaacggatataagaccgacaagatgcatgcagattcctttacggacagtgtcaacaaaaatgcgctgcagatcgccgttcaggtcggtttggaagagcagacagaaatcagtaaattcccgagcttctttgtgagcggatggggcaaatacagcgatacacagtatgcagggcttacagcccaggatgaccgggcaggagtggagatttcctcccagaatccgagcatggatttgaaacagaatctgctgtatctgaaaaaacatgtggacgcagacaagaatatttcctatgagtgggataaaaacatcgcgatcaacctgaagaacagttctaaactgaaacagacggtacagctgatcaatgccagtgacgagatgatgaacctgccgtccgacgatccggagaaatccaaagaggacaatatgtccaggccggaactcacggtaggacttccgttcattgccaacatcgatgaaatgaagtttgactatgtgccgtatgaccaggtgatgagtgacaaagactgcccgcttaatccggattattcagcaaagaatgccgatacacagaaccggttttactggacgtggcgcatcataaatgcagaggatgagacattggcgccgcatatggaagagctgaagctgaaagagggatcaccggtattttaccggaaagcggttgatacgagcagagaccggaacctggtgacctggaggtttgacaacgatttagcgccgggagataagattgtcatcgactacacatacgagattcgggagccaaacatcggagtacctttggaagatatgaccacaaaagtatacggaacgaaagacggttccttccggttcttcatcacagatgacgaggacgaggaacaggcttctctgagagtcgatgtctcagatgtcaacgatgacagcaataagaccgataagaatctggcaatttcaagcaataatattgcatttgaggcattcagcacactgaccagaggcaagaaggtcgtcacagatgtggatgactcttacctgctgaacaccaagccgctgccggtacaggagggaggaaattatacattctcagatatcctgaccaataccgatacaacatccaactactccgttccaattttctttgatgtgctgccgtatgacggtgacaaggccattacaggaagcaaaaacgccgacggttcctatacatctctgacccgtgagtccaagtggaacggctggatcgatttagacagcttcaggattgaaaaagcggatacgggaggaacccacacgctggatgcaggaaagtatgatgtgtatgtgggaccggtgaagaagaatgccgacggaagctacgctctgtatgacatgaaggatatgccggatgtaaacgagagaagtacaaaagaatactatcaggccattgccgatgacgagacgaagttaaatcagcattttgtaaaggcagaagatctgataagtgcaaatcctgacaacatagaagaaatccgcaagggcgtcagaatgtttatggtgcggtttaaagatccgactgcggactttggccctgctaccagctatgttttgaaatatgacatggaagctcctctgaaccttccgtttatgaagggttccgcggatgcagctaaaaatggaaacgacagcgatccgtttgtaggctggaataccttcgccttctgggcaaaacgggatgctccggttgactccgcaagatcaggagtcgtgctccaggcaccaacaggccgcggatatgtgggtgattacgtgtggaatgacttaaacggcaacggaaagcaggatgaggccgagtacaaagaggccaaaaacggaagaatgcttccaagcaaatggaccacagatctggatggagacggaaaggccgacgatccgggaatcaacggagtcaaagtcgaactcctgacggagagtggaaatccgtgcaatgtagacggcgaggccgtgattaataaaaatggccaggattacgtcatggatgagacgacaggagatgtgaagctggatgaatacaacggaactgtgacgacaaagaagaagccttattccactgtaaccagaagcgattactggggcaaccagggctattacattattgcaaatctgaagccgggcaaataccgcctgagatttacaatgccgaacaaatatgacgactatcagctctccacgccgattaccaagactaacacgaaggtttctatcggacataaaggagataatggtctgactgcggagacttatactaccgacagctttggcgtaaaggctattgacctgtcttccgaggcggctgtaaaggcctatgacaaacaggctgtggatgcggatatcggagtcacgaagccggtacgctacaaaggtatcgtttggaaagacctgatcgatgatgacggacagaatcatgaagatacagacttcaacggaaagatcgatccgggcgaaaagcttctggaaggagtaaaggtcactgcttatgagaagggtaatcattccccagccgtgggaatggacggaaaacctctggaagtaatgacagacgcagacggtgtgtatcgttttgacatgctctggccgaacagggaatactactttaccgtggaagatctgagcatagacggacagttaatgaagacatcgccggtgcggctcacaaagaatccgctgaaatacagcaatgacaatgatggaacgatgatcgtttccggaaataaaaacattgccaaaactgagaattttaaagcggttattccgaccgatgaaaacaccggccggccggtatacgacaatgacggcaaacaatatgcggtctgcgacggaatcaattttggcctggtgctggcaaaagcaggatacatcggtgattatgtctgggatgacaagaacagaaacggtattcaggacgaaacagagaaaccgctgaaagacatcaaagtaaaactggaagcttattattatgattctgatcaggacaaatggatcaggattgagaaatatgacaaggagacgatatcatctgaggaaggcgcatatttcttctccaatcttccggtgactgcggcagtctctttcgacgggggaccggacattgattatctgatgggttaccgtttaagcgttccggagatgaaagaagggtatatttatacaaaagcagcccagggaaaggataagacgaaagacagtaatctctattccgacggacgcgtaaaagacgctaagattccgtatatcattctggcagaggagattaagaaagaggacatcacagaggccaacaagaatacggtgatctcttaccagaataagtactatgacacattaaatgcggtctttgacagagactatgacatcggactccttccctatgacaagggagaaatcgaggggctcatatgggacgacacggatgataaagacggcctccagtcaaagaacaaaaaagccgtcaagggaaggactgtatggctggaaaagaaggtagtgccagaagaggagcccgttccggaagaaccggaagaggaaaataaggaggagacagacgatcatactcctgccacggcaaagagcagaaagaaaggaagggatggaacgatccggaccggaaccggaagctatcaggagccggtaatgccggaagatgacacttatgagacgatagcttctgtaaaaactgacagcagcggtgtctttaagttcaaagatctggatgtttataacaaagaactcaaagttccggaaaaataccggatacgcacaaagaaaaataacgacgaggatctgacccttttaaaggttggaaacggaaagaatgcagagatcgacagtgattttggtctctttgacgaagatgaccggctgcatgctatctcaaacagtttccttctggtcaatacgctggagtcagaagatgcctacggaaatctctatgattatgtgactgcacgggacgaaaagacggtggactgcggtatcattaaatatgaaaaccgcgtaaaccttggagataaggtgtggaatgacgagaaccaaaacggcattcaggacgaaggcgagaggggcattaaaaatgttaagatgaatctttaccgctatgatgcagaaggtgatacatggcagacggtgaaagatctccgcggaacgagcagtatcaagaccgataagaatggacattataagtttactgttccggtgacggacctgaatccggaatccaaagattatcttaaaccttaccgttataaagtggaagctgagacaccttatgaggcctttctcacaaaacgaactgcaggaaacgacaaggagaccgacagcgacggctggtacgtggacgaaaacggacagccttctgaagaagagacgatcacgggaattgccggggcaaaagaattcgagtttgtgagcacaagaatgctgaagctgaatgcagaagaggctgagaaacaggggtttgaggaagatgcagacagaatgatggaagtggctgatctgaatacggtaaaagatgatgagagcattgacttcggattcttctataaacaggaggaagtgccttattataaggaaaacaagaaaactccgaagcaggaaccaagacaaaagagacagccgagacgtccgcttcgcgtactgaggaccggggatgacaggaatcttttcatatttattatactgatcgcatcatctgccggggcagcagctgtcctgtacagaaagaaacggaaggacgaagaagcataagaaaaaacatccatcataagcgattttaagtttgtggtggatgtttttctcaatgacaaagacaacaggagggagaacgttggaaaaggcaaaagactttttacagaaaaagagaaatcgagtggccgtggcctttgccgccgcggtgatcctggggattgccgtatattttatgacgaacagtggagaagattccgcagaggtgctttacaaagcggaaaaggaacttgcgggacaaaaaagagaggaaactgcagtaggtatccagaactaccagggaggccttcatccggcgtttgcagaatattcaggagagaagaccctttccgatcttttgttttctcctctgatcaggattaagcaggacggctcaatagattatatcctggcagaagacatcgatgtttcttcgaaagggaaaacatatacagtcagattaaaggacggactgaaatacagtgacggatcaaaacttgccgccgccgatgtgaaaaaagatcttttgctgcttggagacgggagatcttcctttggtttccgtgactgttttgcaaggctcaaaggctatgattcaaataaactgacccagtcagaggatatggaagggattgaagtcaaggatgatacaacgcttgtatttcattttaccgagccggacccggccaatatgtatctgtttacgggaggaatcggcagaacggccaacagggcaaaaaacaagtacttatataccggcgcatttatgctgaagggacagccggccaaccttccgatgactctggaagccaacccgaattattatgacgggaaagtcaaggagaaaaatattcttgtcaaaaatataaacagcaataatatcgaggcaatgctcacgaagggaaatgtggatatcacacagttccaggccaacaaaagcctgatctcccgccttaagaaatccggggtgattaccctgtatcacggaagcagtgatgtacaggcagttttggattttaaatcggacagcaaatcggcagtaaacaaaaaagaagtgcggcaggcagtctgctatgcttttcagaaagagagatttgtgacagactctctgggagacagcgggcaggcagctttttctaattttaaggaaggaagctttatggccggagcggaaaaggaaatgtatccttactctaaggaaaaggcagaggaatgtctgaaaaatgcggggtatgagaagaataaaaaggggatctttgaaaaaggcggaaaggagttgtctctcactctgaaagcggacggcatcctgtatgcggatttatttgtacagcagtttaccaaagatatgaaagcggcaggcatcattgtcaagacgacggattccggaaactatgacctctattaccgcaatgcagccataccttctctgacctcagtgggagcgtttctggacgaaagaaactttcaggatgagaaacttgtaagtctgaatgcccggcttaaaaaggcggaagatttaaaagaagcagggaaagtgtgtaaagagatcgatgaaaaaattctcaatgagagtcttacaatgccggtatatacagaaagaaagtttgctgctgtgggaaatggcagtcataagatagaagtgaaggatattgaccggcccttcagtgaactgttaaaataacaggaagagcagaaccagagggggcagcataggatactgcctcctttttctctgtttcacagagggaaagttttacataacgaactttctcttgaaaaaggcatagactaaaggaaagaagtgaatacaaaagttgacttttcccatagaaaaatgtacgattaatttcggatgtcttatattgacaaggtttaaaatggagtttatactatttcatataatacataccaaaaaagtatgaaatatagaagggacaaaaaatggattggttatttatagaacgaaatatacctctctatatagaggcaatgaaactaacgctgggaatcggagccctgggcgtcgtgctgtcagtggtgatcggattcttatgttctatggtccgttattatagagttcctgtgctgaacaggattgtaggaatttatatagagctttccagaaatacgcctctgctgatccagctgttttttctgtactatggactgcccaagatcggaattaaattaaatgcgtttgttatcgctgtgatcggactgacgtttctcggtgccagctatatgtcagaagctttccgcggagggctggaggcagtcaataagatccaggaagaatccggtctgagcatcgggctcacaaagcctcagctgatgcgttatattatactgccgcaggctttggctattgccatgccgtcggtgggggccaatgtgatctttcttctgaaggagacctcggtgttcagtgcgattgctcttgcggacctgatgtttgtagccaaagacttgattggcatgtattataaaacaaatgaagcgctgtttatgctcgttgtggcatatttaattattttgcttccaatttcggttattttcagtgtcttagaaaggaaggctcggtatgctggcttcgggaattaatattttatttgaaggacaaaatatggcacggctcatgtccggtttggctgtgaccattaagattgccctggtggccgtcgtgctttcattgatattcggggtgatattcgggatcatcatgacctcaaagaatctaatcgtcaaggcggtctgccggctttatctggaggctatccgcattattccgattctggtgtggctgttcttattttacttcggacttacaagggctatgggcatccatctggaaggtgagtttatttctattgtagtgttcaccatgtggggaactgcggagatgggagacattgtgcggggagccgtgacttccatgccgaggcatcagacggagagcggcctgtccctgggactcacgaagctgcagatctaccgctacattttagttccgcagactgtaagaagagtccttcccggtgcgattaatcttgccacaaggatggtaaaaacgacatcgcttgtcgtgatcatcggtgtggtggaggtgctgaaagtcggacagcagattattgagggaggtattttaaatactcctgcggcaccgctctgggtctatggatttatatttttcttatacttcatcctctgctatccgatttccatcgtggctaagaggctggaagcaaaatggcaaagttaggagttagcaaatgggaaatgagttattgaagatcagtcatctgaaaaaagcatttggggagacagaggtattaaaagatatctcttttgatataaataagggagaggtagttgttattctggggccttccggatgcggaaagagtacactgcttcgctgtatcaacggactggaagaatttcagggcggagagatcagcctggacgggcagagcctttcggacgggaaagtgccgtggcatctgatccgccagaagatcggcatggtatttcaaagttatgatctttttccccacatgaccattctggacaatatccttctcggtcctacgaaagcacagaaaagagacccgaaagaggtaaaagagatggcggttgccctgctcaagagagtcggactggaagagaagaaggatgcctacccgagacagctgtccggcgggcagaagcagagagtggcaatcgtcagatctctctgtatgaatccggagatcatgctgtttgacgaggtgacagcagcgttagatccggagatggtaagggaagtcctcgacgttatgctggaactggcaaaacaggggatgaccatggcgatcgtgacccatgagatgcagtttgcgaaggctgtggctgaccgggtgatcttcattgacgagggacgcattgtggaggaaaatactccgaaagagttctttgaacatccgcagacagaacgggcaaagaagtttttaaacatgtttaattttgaggagatgaaaaaagatgaagaaatttagcagaatcttagtagtactggcagttctcagcatggctatagggctgatgacgggctgcggaaacaaaaaatcagaaaaaagtgataatcagtcttctgtagaacagatcaagaagaacggtaagatcaaggtcggtgtattcagtgataaacctccgttcggatatgtagataaaaacggaaagaatcagggatacgatgttgtacttgcccaccgtctcgcaaaagatctgcttggagatgaaaacaaggtggaatttgtgctggtagaagcggcgagccgcgtggaattcttacagagcaataaggtagatgtgatccttgccaactttacggtcactgacgagagaaaggaagtcgtggattatgcacttccatatatgaaagtttctctcggtgtggtttctccgaacggaaaagttattaccgatgtaaaacagttaaaaggaaagaagctgatcgttaataagggaacgactgctgaaacttatttcacacagaagtatccggatattgaacttttaaaatatgatcagaacacagaagctttcaatgcattgaaggacggcagaggagctgctctggcacatgacaatacactggtatatgcatgggcaagggagaacaaagggtttaccactgggatcaaatctctcggtgagcatgactttatcgcaccggctgtcaaaaagggaaatgatgacctgaaaggctggatcgatgatgagatcaccaagcttacaaaggaaggattctttgagaaggattataagaagactctgcttcctgtatatggaaagacggttgaagccgatacggtgatcatgaacgaaaaagaattaaaagaatataagtaagacaaaaaccgatcagggaactccagggagtataccgatcggtttttttgtatagcagcgacagacttgaattgcagatgtaaaatattgacaaacaagtgttggaaggttataataaaataaaaaacaaggaggatgtcatgctaaagttagagatcaaattggacgaatccaaaattaagtcggaacataaatatgatgcaaacagtatatatcgaacactggagaaaagttttttaaaacatgatatacccatgattcaagagtgcgatggtacactagtttttcgtggcaaaggccatccgagcgactatggtgcttttggaggaatcatccctcagctgaaagaaaaagattggtttatggattatgtaataaaatggatgtggtataacagtgatgatggtgcggatgaagaagactattcggtggaggatgtactgtatttttatacaaaaagggatagtgttgcataatgccatctggagaaaagaaatattataaagcaatttatattgaccttaaaatgaaagctttagagaaacatttctccgcaaaaaatccacaaaaagcctaccaaaaaattctgatggaggtatttgcggaagaggcgatggaactaaaggttactcaataaatttcaaaaaaccagttgacgttttcggcaccgtatgatatattactacaagtatcactgccgaagacagcaggcgccgtatggcgtaacgtagaacggcctgccgaggatgatgattagtattgagctaattgtgccctttgtctttgcggacaaagggcttttcttattcttatagaaaattctgcggaatttggatccaagcggcggtacactaaaataaatcaaggaggtgcaccattcattatggcaaaagtagaattaaaacaacctatcgttaacgaaatcaaagaattgcttacagatgctcagtcagcagttttagtttcttaccgtggtatctctgtagaagaagatacagcaatgcgtaaggaattaagagaagcaggtgtagagtacaaggtatacaaaaatacaatgattcgttttgcggtaaaagatacggaatttgaaccgttgtctgctgaccttaccggaccgactgcgatcgctgtttccaaaacagacgcaactgcaccggcaaggatcttagcaaaatacgcaaagaacattgaagtattcagcctgaaatctgcggttgtagaaggaactttctacgacaaagacggcgtacaggttatcgcaagcattccgtcaagagacgaattacttgcaaaattcctcggaagcattcaatctccgattaccaactttgctcgtgttattaaacagatcgcagagaaagacggagaagctccggcggaagaagcaacagaagctgctgaataatcggcggtttacattaaattaattattaggaggaaataaaaatgacaactcaggaaattattgaagttattaaaggtttatcagtattagaattaaatgatttagtaaaagcatgcgaagaagaattcggtgtatctgcagcagcaggtgttgttgtagcagcaggcggagcagcagacggtgcagcagctgaagaaaaagatgagttcgacgtagagcttacagagatcggcggagctaaggttaaagttatcaaagtcgttcgtgaagtaactggcttaggcttaaaggaagcaaaagaattagttgacggagctcctaaagtgatcaaagaagctgcatctaaagcagaagcagaagacatcaaagctaagttagaaggcgaaggagcaaaagtaactttaaaatagttctttgtttcatatctaatgtaagaaaacttcatgaaagaatcggctggccatgccagtccgattctttttgcgtctattgaaatttgtgcttgacacggcatagacactgtggtattattaggcgatgctttaatatgggattgtatgcccatagccgagcctttttttcgttatataaattgtgagagattcgcacaatcagaagtagtatataaaccatgtagaaatcaagaggtgaacacgtccatggaaaaaaacagaattcaaccaatgaaatcgggtacgagcataaggatgagttatgcgagacaagatgacgtcttggaagtaccgaaccttattgaaattcaaaaggactcttacaactggttcttgggggaaggactcaaagaggtatttgaggatatttctccaattggggattacagcgatcagcttagcctggaattcatcgattttaagctgtgcagggatgatatcaagtattccatcgaagagtgtaaggagagggatgccacatatgccgctccgatgaaggtgaaagtaagacttcataataaggaaacggatgaaatcaaacagcacgacattttcatgggcgacctacctttgatgacagatacggggacatttgtgatcaacggagcggaacgtgttattgtcagtcagctggtgcgttctcctggtatctactatggaattgcccatgataaaattggtaaaaaattgtactctgcgaccgtgatcccaaaccgcggtgcatggcttgagtacgagacagactccaatgacattttcaatgtgcgtgtggaccgtacaaggaaagtgccgattaccgtattgatccgtgctctcggaatcggaaccaatgcggagatcaaagaattattcggagaagagccgaagattcttgcaagtatggagaaagatccgtctgataactatgaggacggtttattagagttatacaaaaagatccgtccgggtgagcctctgtccgtggacagcgcggagagcctgatcaacagcatgttctttgacccgagacgctatgatctggcaaaagtcggacgctacaagttcaataaaaagctggcattcagaaaccgcattaccggccatatgcttgcagaggacgtgattgatacttccacgggagagatcctggcggaagcaggaaccgaagttacactggaactggcagataagatccagaatgctgcggttcagagtgtgctgatccagactgaattcggcaatacaaaagtattatctaatatgaccgtaaacctggccgaatatgtagattttgatccggaagaacttggcatccatgagaatgtattttaccctgtgctggaaaagattctggcagaaggtttaagcggtgatgaattaaaagcggcagtgaaaaagaacattcacgacctgattccgaaacacattacaaaggaagatattttagcgtctattaactataatatgcatctggaatataatatcggaaaccatgatgatattgaccatttaggtaaccgccgtatcagagcggtgggagaattgttacagaatcagtaccggattggtctttccagactggaaagagttgtccgcgagagaatgacgactcaggatatcgagacgatcacaccacagtctctgatcaatattaagccggtgaccgcagcagtgaaggaattcttcggaagttcccagctttctcagttcatggatcacaacaatccgctgtctgagctgacacacaagcgccgtctgtctgcattgggacctggaggattgtccagagaccgtgcgggattcgaggtgcgtgacgtacactactctcattatggaagaatgtgtccgatcgagaccccggaaggtccgaacatcggtctgatcaactctctggcgacttatgcaaggatcaacgagtatggattcatcgaagctccgtaccgtgtattggataagacagatcctgaaaatccagttgttacggacaatgttgtatatcttaccgcagatgaagaagataattttgtcgtagcacaggcgaatgagcctttggatgaggacggacattttgttcacgcccatgtatccggccgtttccgcgaagatacttcagagtttgataaggcaaatctggatctgatggatgtatctcctaagatggtattctcagtggctacgtcaatgatcccgttccttgaaaatgacgatgcgaaccgtgcactgatggggtccaacatgcagcgtcaggccgttccgctgctttccacagaggcacctgtggtgggaaccggtatggaatccaaggcagcctttgactccggtgtatgtatcgttgcgaaaaacgacggagtggtggagaaatctaccagcacaaaaatcgttgtgcgcagagactctgacggcggcaaagacatttacaatgtaattaaatttgcaaggagcaaccaggggaactgtatgaaccagcgtccgattgttttcgagggggaccgtgtgaaaaaggatgatatccttgcagacggagcttccacaaagagcggagagatggcacttggtaaaaatcctctgatcggatttatgacctgggaaggttataattacgaggatgctgtcctgctgagcgagcgtctggtacaggaagatgtgtacacctctgttcacatcgaagagtacgaggcagaggcccgtgatacgaaacttggacaagaagagatcacaagggacctggcagggttaagtgaagacgtattaaaagacctggatgaaaacggtattatccgtatcggagcagaagtccgtgcgggtgacatcttggtcggaaaagtaacaccgaagggagagacagagcttacagcggaagaacgcctgctccgtgctattttcggtgaaaaagccagagaagtccgcgatacctcattgagagttcctcacggagcttacggtgtcgttatggatacgaagatctttacaagagagaacggagacgaactgcctcctggagtaaataaaacagtccgtgtctacatcgcccagaagagaaagatctctgtgggagataagatggccggacgtcacggtaacaagggtgttatttcccgtatccttccggtggaggatatgccgtaccttccgaatggccgtcctctggacatcgtgctgaacccgctgggtgtgccgtcacgtatgaatatcgggcaggtgctggagattcatctgtcccttgcggcaaaagtattaggatttaacgtggcaactccggtattcaacggagctgatgaggacgatatcgctgtgacactggaaatggccaatgattttgccaacaccagctgggaagattttgaggcgaaatggaaagaccgtgttgacggtaatgtaattgaatttttgagagaaaatcaggatcacaaaaaggattgggaaggcgtgccgatcgacagtaccggaaaagtaagactgagagacgggcgaaccggagaagagtttgacagcccggttacgatcggattcatgcattacctgaaactgcaccatttggttgatgataaaatccatgcacgttcaacaggaccatattctctggttacccagcagccgctgggaggtaaggcgcagttcggcggacagcgcttcggagagatggaagtttgggccctggaagcatatggggcatcctatacactgcaggaaattctgacagtgaaatccgatgatgttatcggtcgtgtgaaaacatacgaggctatcatcaaaggcgacaacattcctgagccgggtattccggaatccttcaaggtactgctgaaagaattccagtctctggcattagatgttaaggtactcgatgaaaatgcggaggaagtcgagatcaaggaaaatgtagacctggctgacaccaaccaggacctgaaaccgatgatcgaaggcgacagcgtatttaataattatgaagaaaacgaaaattccctgggagctttagggtttaaagaggggaactttgaagatggcgaagacactactatttcatagaagtgcagatagaaggaaggagcaaccttaatgataggatcaagcaacgaatattcaaatcataaaattgcctttgatgcaattaagatcgggttggcttccccggaaaagatccgagagtggtccaggggagaagtaaaaaaacctgaaaccatcaattatcgtaccttgaagcctgaaaaagacggtcttttctgtgagaagatattcgggccaagcaaagactgggagtgtcactgcggtaaatataaaaaaatcagatataaaggtgttgtctgtgaccgatgcggagttgaggtgacaaaagccaacgtccgccgtgagcgtatgggacacatcgaactggcagctccggtttcccatatctggtacttcaaagggattccgagccgtatgggactgatcctggatatttctccgagaagtctcgaaaaagtattgtatttcgcctgctatattgtgctggacgcaggagagacggatctggcttacaaacaagtattgacagaaaaagaatacagagatgcctatgataaatacggcagttctttccgcgtgggaatgggagccgaatctatcaaggaactgctggaggccatcgaccttccggcagaggcaaaatctttaaaagacgaatttaagacggccacaggacagaaaagggcaagaatcgtaaaacgcctggaagtcgtagaagccttcttaaactctgaaaataatcctgagtggatgatccttgatgtagtaccggtcattcctccggatatccgtccgatggtacagctggacggaggacgttttgctacttctgacctgaatgacctttacagaaggatcatcaacagaaataaccgtctgaaacgtctgctggaactcggggctccggatatcattgtgagaaatgagaaacgtatgctccaggaagcggtagatgctctgattgataacggccgccgcggacgtccggttacaggaccgggtaaccgtgcgctgaaatccctttccgatatgctgaaaggtaaacagggacgtttccgccagaacctgctcggaaaacgtgttgactactcaggacgttctgttattgtcgtaggaccggaactgaagatttaccagtgtggtcttccgaaagagatggcaatcgagctgtttaaaccatttgttatgaaagaactggtggaaagaaaactttcccataatataaaatctgccaagaagatggtagagaagctccagccggaagtatgggatgtgctggaagatgtcatcaaagaacatccggttatgttaaaccgtgcaccgacactgcacagacttggcatccaggcatttgagccgatcctcgtagaaggtaaagcgatcaagctgcatccgctggtatgtactgcttacaacgccgatttcgacggtgaccagatggctgtccatctgcctctgtccgtggaagcccaggctgagtgccgcttccttctgctgtcaccgaacaacctgctgaaaccttccgatggtggtccggtagccgttccttcacaggatatggttctcggtatttactatctgactctggaaaaagagggagataagggagaaggcaagtactttaagtcagaaaatgaggcgtttcttgcctacgaaaataaagcgatcaccctgcacgcaaggatcaatgtaaggcgtacaaagattgataaagacggaaataagatttccaaggtcgtacagtgcactctcggaagaattttattcaatgagatcattatgcaggatctgggatttgtagacagatccaatccggaaaacgcactggacttagagattgatttccacgtaggaaagaaacagttaaagcagatccttgacaaatgtatcaatatccacggcgctacaaagacggccgaagtacttgatgatatcaaggcactgggatacaaatattctacaagaggagccctgaccgtttctatttcagatatgacagtgccggaagagaaaaaggaaattcttgcaggagcacaggatcaggccgagttcatcaacaatcagttcaaacgcggtctcatgacagaagaagagcgctacaaagccgttgtcaaaacatggtttgacgccgatgacgttttgactgacaaactgatcacaggattagataaatataataacatctttatgatggccgattccggagcccgtggttctaatcagcagatcaaacagctggcaggaatgcgtggactgatggccgatacgtcaggacgtaccattgagctgccgatcaagtccaatttccgtgaaggtctggacgtactggagtactttatctctgcccacggtgcgagaaagggactttccgatacggccttgagaactgccgattcaggttacctgacaagacgtcttgtagacgtttctcaggatctgatcattcgggaagcagactgcggactggatgcggacggacagattcctggcatgtatgtggaagcgttcatggacggacaggaagttatcgaaagtcttcaggaccgtatcacaggacgctatgctgcagaagagatcaaacatcctgaaacaggagaagttcttgtaaagtcaaaccacatgatcactccaagaagggctaagacggtcatcgatgcaggccttacaaaggtcaagatcagaacgatgctgacctgccagtcacaggtgggatgctgtgcaaaatgctacggctccaacatggctaccggtcaggcagtacaggtgggtgaggcagtcggtatcatcgcggcacagtccatcggtgagcctggtactcagctgaccatgcgtacgttccatgccggaggagttgccggtgacgatatcacacagggtcttccgcgtatcgaggagctttttgaggcgagaaagccgaaaggtcttgccatcatctctgagtttgcaggaaaagtgcagatcaaagatacgaagaagaaacgggaagttgtcatcaccaataaagaaaccggagacatgaaggcttatctgattccttacggttccaggctgaaagtcatggaaggacaggaagtggaagccggagacgagctgaccgaaggttccgtcaatccgcatgacatcttaaagatcaaaggtatccgcgccgttcaggactacatgatccgcgaagtgcagagagtataccgtcttcagggtgtagatatcaacgacaagcacgtagaggttattgtccgccagatgctcaagaaagtccgcatcgaagaaggcggagacagcgattacctgcctggcgccatgatcgacgtgctggaatttgaaaagacaaacagagagctggaagaaagaaacttagagactgccaaggcagaacagattattctcggtattaccaaggcatctcttgccacagactctttcttgtccgcagcatctttccaggagacgacaaaagttcttaccgacgcggccatcaaaggaaaggtcgatccgttggttggattgaaggaaaacgttatcctcggaaaactgatcccggcaggaaccggaatgaaacggtaccgcaatgtaaaaatcaacacagaggaagaagaactgacactcgaagacgaaatcgatttcgaatagagtcaaggttttaacaggtcccgtccctgcatccgcaggggcgggatctttcctgatttattgggaaatccccttgacaaacgattttgccgcatttataattaaaaaatgcgcgtagatatctatgtgcaacaactgatcataagtaactacagcagaaaacatgcatggaggtgaaaattaatgccaacttttaaccaattagttagaaaagggagaaagacatctacaaagaagtctaccgcaccggctcttcagaaaagttttaactctttaaagaagagatcagtaaacgcaagctctcctcagaagagaggggtttgtacagctgttaagactgcgactcctaaaaagcctaactctgctcttcgtaagatcgccagagtacgtctttctaacggtatcgaagtaacaagctatatcccgggtgagggacataacttacaggaacatagtgttgttctgattcgtggtggtcgtgttaaggacttaccaggtacccgttaccatatcgttcgtggaacacttgatacagcaggtgttgcaaacagaatgcaggctcgttccaaatacggagctaagagaccgaagaaataatcaaacgaaactaaattggtacaaagcagcgtaacattacgctaccttgtatagttgtgccggaaatgaatgttttccctgtagaacaggagatagatataaattctggcacgatcaggcattgagcgcttgaaggccggcggaaagccggtagctgcgcaaggatgaatgagtaccgatgaattaaggccggcggcatgccagaaaaaggtataaaatttctgccgttggcaattattaaggagggaagaaacgtgccacgtaaaggacatattgcgaaaagagatgttttggcggatcctatttacaataacaaagttgtgacaaaactgatcaacaacatcatgttagacggtaaaaagggagttgcccagaagatcgtatacggtgcattcaaccgtattgaagagaaagccggaaagcctgccctcgaagtattcgaagaggcaatgaacaacattatgcctgtgctggaagtaaaggccagacgtatcggcggagctacctatcaggtaccaatcgatgtacgtccggacagaagacaggcccttgcacttcgctggttgactttatactctcgcaaaagaggggaaaagaccatggaagaaaggcttgcaaatgaaatctttgatgcatccaacaacaccggagcatctgtaaagaaaaaagaagacatgcacaaaatggcagaagcaaacaaagcattcgcacactacagattctaatctggtgtgcggggcctaccgctttatccgaaaaacaataggaggaaaagatcttggctggaagagaatatccattagagagaaccagaaatattggaatcatggctcatatcgatgctggaaaaaccactttgacagagcgtatcctctattatactggtgtaaattataagatcggtgatactcatgagggaactgctaccatggactggatggagcaggaacaggaaagaggaatcacgatcacttctgcagcgaccacatgtcactggactctccaggaaaactgcaaaccgaaagacggagcattagaacaccgtatcaacatcattgatacaccgggacacgttgactttacagtagaagtagaacgttccctgcgtgtactcgacggtgccatcggtgtatttgatgcaaagggcggagtagagccgcagtctgagaatgtatggcgtcaggcagacacttatgatgtaccgagaatggcattcatcaacaagatggatatcttaggtgcagacttctacggttctgtagagcagatcaaagaccgtctcggtgccaatgcagttatgattcagctgccaatcggcaaagaagacgatttccagggaatcatcgacttgtttgaaatgaaagcctacatctataatgatgataagggagaagacatttcaatcacagatatccctgatgatatgaaagatgatgcagaaatgtatcacactcagttagtagagcagatctgtgagttagacgacgatctgatgatggaatacctggaaggggaagagccatcagtggaagcattaaaagcagcactgagaaaaggaacatgcgaatgtacagcagttccgatctgctgtggtactgcttaccgcaacaaaggtgttcagaagttactggacgctgttcttgagttcatgccggcaccgacggatatcgctgccatcaagggtgtggatgaagacggaaacgaaatcgaaagacattcatctgatgatgaacctttcgcagcacttgcatttaagatcatgacagacccattcgttggaaagcttgctttcttccgtgtttactccggaacaatgaattcaggttcctatgtattaaatgctacaaaacagaaaaaagagcgtgttggacgtatccttcagatgcatgccaacaagcgtgaagagttagacaaagtttatgcaggtgatatcgcagctgccgtaggtttcaagatcacagcaacaggtgatacgatctgtgacgagaagagtccggtaatcctggaatccatggaattcccagagccggttatcgacgtagcgatcgagcctaagacaaaagcaggtcagggcaagatgtcagaagcacttgcaaaacttgcagaagaagatccgaccttcaaagctcatactgatgaagagacaggacagactatcatttccggaatgggtgagcttcacctggaaatcatcgtagaccgtctgcttcgtgagttcaaagtagaagcaaacgtaggtgctcctcaggttgcttacaaagagtccttcacaaaagaagtggatgtggacagcaagtatgcaaaacagtctggtggacgcggtcagtatggacactgtaaagtacactttgagccaatggatgccaatggtgaagaactgttcaagtttgaatccactgttgtcggcggtaacattccgaaggaatatatcccggcagtcggagctggtatcgaagaagctgctcagtgcggtatccttggaggattcccggtacttggtgtaaaagctactgtatacgatggatcttaccatgatgtcgattcctcagagatggcctttaagatcgccggttctatggcattcaaagaagcgatgcagaaagccggagctatcatcttagagccgatcatgagagtcgaagttacaactcctgaagattacatgggagatgttatcggtgatatcaactcacgccgcggacgtatcgaaggtatggacgatgtcggaggcggaaagatcatcagagctttcgttcctcttgcagaaatgttcggatactcaaccgacttacgttccagaacacagggtcgtggaaactactctatgttcttcaacagctacgagccggtaccgaagagtgtacaggaaaaaatcatcgctgataaaacaaaataagcaggtttttttgataaaaaaatatgcttgaattcttcaaagaaatgaaatataatcaagggtaggacggcctttggtaaggtgattcgtcgacccggtagtaaataataatttatctatttgcccaaagggctaataaggaggacatttaaaatggctaaagaaaagtttgagagaaccaaacctcattgcaacattggtaccattggtcacgtcgatcatggtaaaactactttaacagctgctatcacaaagacattaagtgccagagtagatggaaacgcagccgttgatttcgaaaacatcgataaagctccggaagaaagagaacgtggtatcactatctccacagctcacgtagaatatgaaacagataaccgtcactacgcacacgttgactgcccaggccatgccgattatgtaaagaacatgatcactggtgctgctcagatggacggagctatccttgtagtagctgcaactgacggtgttatggctcagacaaaagagcacatccttctttcccgtcaggtaggcgtaccttacatcgtagtattcatgaacaaatgtgacatggtagacgatgaagagttattagaattagtagaaatggaaatccgtgagttattaagcgagtacgaattcccaggtgatgacactccagttatccagggatctgctttaaaagctcttgaagatcctaacagcgagtggggagataagatcatggaacttatggctgcagttgacagctggattccagacccacagcgcgatacagacaaaccattccttatgcctgtagaggatgtattctctatcacaggacgtggtactgttgcaacaggtagagttgaaagtggtgtgcttcacgtatctgaagaagttgaaatcgttggtatcaaagaagagacaagaaaagttgtcgtaactggtatcgaaatgttccgtaaacttcttgatgaagctcaggctggtgacaacatcggtgctcttctccgtggtgttcagagagaagaaatcgaaagaggacaggttctttgtaaaccaggttctatcacatgtcacacaaaatttacagctcaggtatacgttttaacaaaagatgaaggtggacgtcatactcctttcttcaacaaataccgtcctcagttctacttcagaacaactgacgtaacaggtgttgttgaattaccagaaggtgttgaaatgtgcatgcctggtgacaacgtagaaatgacaatcgaactgattcacccaatcgctatggctcagggattatctttcgctatccgtgaaggtggacgtacagttggatcaggacgtgttgctacaattattgagtaatcagtaatttttgtattagtacgaaatgtaaaactgcagtctctataaaagagactgcagttttttgtataaaatattaaaaatgtgtttattactaaaaaatagaaaaaaagaatataaatagataaaaattacatttgaatattgaaaagcaaattgcagaatgctataattaatattacaaacaaaagcaatgaatagttgcaccgagtagagaaaatgttcagagaatttaaaagattaaaagatctaatatatggatataatagtgtgccggctcaatatatgaattattgatacagccagtttttaaagattgcggagaataattcaaacaagttattcttcgctttattcgtcagctgcacattatacgttatttatgtcataagattgatacagttgataagaaattgtttcttcggaaggccaaagaaaaagatagagacactttcttttacctattttacaaacccggtttggaaaataaaaatgatcttgatagtcaagaattgtataaaatttcggttaaactatcaatatattgttggaggtgtgtaaatggaattatttcatggaagcaatgtaattgttcaacatccaaagattttgaccaacggattctataaggattttggttatggatattattgtaccaatatagaaaagcaagccaaacgatgggcacttacaaaaaaaaatcaacatattgtcaatgtatattcatatgagccaaaagagattttgaagataaaaaaattttcagatttgtcagaagaatggcttgattttatagtagactgccgcagcggtttagaacacaaatacgatattgtagaggggcctatggcagatgatacaatatgggattacatcgaagattttatagaaggaaatatttctcgtgaggctttttgggtgttggtaaagtttaaatatccaacgcatcaggtagtgttctgcacacaggaagcgttaagtacattgacttttgaaaggagctatatattatgaaaaatatattctttccagaggaagaaataacgaagaatgatctatattttatttgttatatggtagaatgtgtggcaagaaaactccatcaaagcaatttatatgtagttaatcgtataggaaagaaagaactaatgcgtttgctcagtctggccaatgttctacattgtgaaaatccgctaaaagttgaagaagaatggattaaagaatatcagatgacgcagggaagtgtagatgtattagatgtgaatacagagttagacgtacaaattccaagagaaacccagatggggaaagtatatacacgtttgattttagatactatgcagcctgaggaagactatgcggaagcaatcacaagagtatataacaatccgatatgtaaagtgattgataactataatgccagtgcgttttatgagccttcctatgtaattgcaagggcatataatgagggtggtttttaaaatatatgcttctatgggatcaaatttgcttgctatgacagactattccttaccaagagtggaagaggccgctttgtcgtaatggatagattccaggatattgcgaggatttttgactaaagttcaagcaataagaacctataatcatcagctgatttatcaaatccggaaaatcaaaactaagattttccggatttttttcatggctgacggttgatcctgagattttttacaaagccgaggatcatttaactctccccgctccccaaggtactcaccatcatataccgatcggccctattaatcgtaatacagtactccacaattttttcttcgtcatatgtagtggatttaatgcagaatccaatctcattttcttcagcattcaggtaatgactttcttcatcagtcaacgtagtgatcgtgatcgtctcgtcaattctcttcaagttcagcttatatgtacgaatcaaagtatcatataaagattcagcagcaaaattatatcgttccaggccgggacagtatttttcagggataaaggaagtctccactagaaaaggttcatcctccaaatagcgtacccgcatcaaacagtaaaccggttcacccagagtgattccaagatggctgctgacagacaaagaagcttcccgtttatcaaaggaaagaaccctgctggaagtcttaaacccgtctgcaccccatccgtcggtaaaagaactgaatttttccgtatcatcatctatttttggaggtgcaataaaattgccttttccatgccgtgtgaaaatatgatgttcatagcgcagccttttcagtgcagagcggaccgtcagcctgtttacctgaaatgcttccgccagtttacgctcggaaggcagaggatcataaggcttcagatcattttcaatgatatatgcttcaatcttatcttttacttcttcactcaaaagattgatatatttgctcatataggtctccttacgttaaagtggatgtaaaggtaatcgtccgttcactgtaataggagcgggtatattcaatggttttaccggaagaattggtaactgtgttatggagcatgaacacggcagagccttcttccacattcagcagagccgcctgcggattcatgactcttacgatttccagtctctgagtatcctgcgtaagtttgatccgattcgtctcaagcaggtcataaaaagagcactgttcaaaatcatagctgtccaagtccgggacaatgtgatatggagtatatgtatattctaaggcgaatggttttccgtttgccagtcgcagccggaacagaaggaaaatgtcatcttccggatctatgtcaaatattttagagtattttgctcctgcttttgcttttttggtaagcagaactttattggatggcagcaaacctgaatcctgaatgaactttcccatagactgaatgctgtcgagaggagaatggacagcggcctggctgacataggtgcctttgccatgctgccgggttaaaaggcctttttcaattaatacttctattgcttttcggacggtcatgcggctgatcccaaaagcgtctatcaattctctctcggaaggaattttacttcccaatggatattcatttttatttatttttctttcgatcaaatcagcaagctgtaaataaacgggatattttttcggcattttgcacctcctgccaataaagactggtattctctcagcctctttctaaaaaaaacagaaaaatcagtggtatctgaatcagtgtttcaagactgccaaaagacagagattttaataactggtttgctcatctggtatatagaaagaatataccagttaggaaaaaaagtcaagtggtatggaattaaacgaaaaaaccaaatctgtaaaaaatccaaaaaaagcagtaaaattatataaagtgcacaaaaatacaagatgcatagcgataataaatgggagtattgacatgtagaaattaaaatggtatactaaaagcaccaagacgtatacgtggtatataacaagaagtgatggagttgaaaggagattataaaatgacatacaaaaattatgacagagaaacttacttaaatagctttaaagagatcatgaaattaaaaccccaggttgaaaaatatattgacgatgcatttgaaaaaggtgtggataatctggttatggccggagtgggaggcagtatttccatcatgatgccgatggaatatttcgcaaagaaaagaacggcgatgccggtttatatggaaaatgcggcagaattagtgttgggaattaataaagcaattacagaaaaatcactggttgtcctttacagcgaatccggaactacaaaagaagccattgcggcggcagagtactgcagagaaaaagggattccgaccattggagtcagcggaaatgaggaagcgccgttacagaaactgctcacatatccgatcgtctgcggtgcgggagatgaactttcctgtgacggagaccatatgaaactctttctgatcgtcagcgcaattttacataagaacggcgacatggatgactacgatgaattcatggagaaccttgcaaaactgccggaagctttagctaatataaaagaagaagtagacgaagaggcaaaggcatatgcatatcagattaaagatgaaccatatcacatgctggtgggttccggaaacttgtggggatcaacttactgctttgcaatgtgctatctggaagaaatgcagtggattcgcacaaaatccattgaatcaccggaattcttccatggcacgctggagcttttagaagaagacacaagcatcatgatcttcaagggagaagatgagaccagaatgctgactgagagggtagagaactttgcaaagaagatttccaagaaagtaaaagtcatcgataccaaagaatatgaggcagaaggaatcgcagaaaaatacagaggagatttgtcaccggcattcttagaagcttatctcggacggctgacggcacatttggaagatgcaaccggacattcccttgacatcagaagatattacagagtgatggattactaagaaattttcagcaaacttttctatgacagaaaggagaacaggcagtgggcaaacagatggaagactatatacaggagacatcctctgtgatggtccgaaacattgaacagagaaaggaactgacaaaacccctgattggctggcttttaaaggaagggatcagacaggggaagacactcgtgatcgtggcatccggatcttcttatcatgcggcacaaagtgcgcttgcgtttatggaaacgtacatgaaaaggccggtccgcctgataacgccgtttgcttttacttactatgaagaactgaaagaaaacaatctttatctctttgtttcccagagcggaagcagcaccaatgtggtagaagcgatcgagcggtatcagagggcaggataccacgcaatggcagtccttgggaaaccggggtctgcgattgcagagctttccgactcctacgtggaatacggcgcaggggaagaacgtgtcggatatgttacaaaaggaatgagcacactgacttgtttcttcatgctggtatctctggagttgtccacagaggatatagagaaagaagtttatgaaaaggcagtcagggagctgacatgtgcatgtgaaaaccaccatcgggtttatttgcaggcaaaagaattttgtttggcaaacaaagagacattattgacgatgaaacatgcatttttcatcggctgcggagcaaatatgggaaccgtgaaagaaggttccctgaagctctccgagttagtacacataccaacggcatcatttgaaacagaagagtttatccacggaccggaccttcagctgacaccggactatacattatttttcgtcagttctggagacccggcagggaaacggacagaagagatctgcggcgcagccagggaggttaccgagaattcatttttaataaaggcagatcttagagaagaaaacggaacagacgagattgtttcaccattatatctgactgcattttttcaatatctggcttactggacggcaaaaaacaggaacataacgacggaacatccgctgtacataaaatttgaagaaagaatacactgcaaaacaagcgactatgaagaagatctgccattttagggaaaggagatgatacggtgcgccatatcattttgacgggacattcccgcatatcagaggggattgcaactgccattgaatttgttttaggaaataaaataccatactttaatgcttatatggaaggagaggagctgtattccaagaaacttcgggagaagatttcggaatacccgccgcaggatgatattatcatactcactgatattctgggagggagcgtcaacaatgatatgatgaagttcctggaccggccgaatctccatttagtgtgcgggatgaatctgccgctggcagtacatctgatcttatcagaggaagaaaatacagaacagttaatcaggcagggcattcaggcggcaaaagacggaatccagtattgcaatgacattcaggtttcagccaatatggatgatctgggggacttttaaataggaaaggagaagatacaaatgattaaaaaggtgagagttgattatcgtctgctgcatggacaagtagcattttcatggacttccaagctgagtgccgactgtattctgcttgtcacagacacgcttcaggatgatcctgtgagggttacttctgtgaaactggcaaaaccgccgggagtcaaagttgtagtaaagaccattgaggaaagcatcaaagcgatcaaaagcggcattacagataaatatcatttatttgttgtgtgcgagaacatcgagggtgcctaccgcctggtcaaggagcttgggatcaaggaactgaaccttggagggacaacaccgggagatgataaaaggtctctggcaccggttgtttatgtaaatcagaaagaagaagagatgttaaaggaactgatagaggacggagtgcatgtctaccagcagggtgtgccggaaaaggcagagcagacgatacgtctttagaatatgaaaaggaggaacagctatgagtacaggagtacaggcagttctcctgggaatcttagggttttgtacaaactttgaatggtttctggggacttgtatgatccaaagacccattgtcataggcccttttgtcggactcattatgggagacttccaggccggaattatcatgggagcaacgatggaattggcatttgccggcgcggcatcgatcggggcatatgacccgccggatatggtcagcggaacgattctcggcgtggcgcttgccatcaaagcaggggcaggaccggagatggcgctgacccttgggcttccggtagcgagcatcgtactggcgatcagcaacgtgacaggatatccgattctgaacttttttgcccatctgatggataagaatattgccgacggcaatgaccgggcatttcagagaaactttattttaagcggctttgtggcgtggggagtgacaacgccgatcgtgccgattgcgttttatcttggatcagacaaaatttccgcactgatgaaattaattccggagtttgtgcagacaggtatggagattgcaggaggacttctgccggcgatgggatttgcccttctggcacagatgattatgaaaaagagcatcgctccgtttttctttatcggctattttatcgtcgcctattcaggggtatcaacaaccggtgttgctttatttgcaatactgattctggcagcactgtttggaatctccagcaccggattgttcggatcaggccgggtgccggctgtcgctgatgaaacggaagggggagatttcgatgagttttaacatacatgccgactataatgggaagattacaaaaagtgatctgaggaaagtgtggctccggtcgatcccgatggagcattcttggaactatgaacgtatgatgcactccggttactgctttgccatactgccgattctaaaaaaactgtatccaaacaaagaagactacatcaaggctttgcagcggcatatggaattatacaatgtgaccatgtacatttctacgctgccgcttggaatcacagcagccatggaagaaaaaaatgcggaagatccaaattttgataccacatctatttctgcggtaaagacggcttttatggggccgctgtcaggaatcggagatgcgatgtatcacggaactctccggattatcgcaatgggaatcggtgtttctctggctatgaaaggcaacatactgggcccgatcctgttttggctgatttttaacataccgaacttcggactgcgctatccgctgacatttctcggatataaactgggcgtggaggccatggataaattagagaaatccggaatcatggataaagtcatgcaggcagccagtatcctaggactcactgtcgccggcgccatgaccgcagaaaatgtgtatctgtcgataccgattaagttcggaataggaaaggatgccacaacggtgcagtcaatcttagacggaattatgcccggaattcttccattggctttgttcggtgtgatctattacatctttaagaaggataagtgcaacccgatcgtgatgatgttactgctcatggtacttggtgttgtaggagcattttttggattccttgggtaagaaatcatgtatgaagcaatcatatttgatatggacggggttatcatagacagcgagatcgtctattataactggcttaaagaactgttaattgaaaaggaatgtatgattccggaaaatgaactgaaaaagattgtcggtttatcaaattcccagagccgccagatgatgatggaatggttcggcagggaaaagggcagcaggctttgggaaacttattgtgaggaggaagagggatatgagctttcttacagggacatcattaatcctggtacagaagagatactcatgcttttgagaagacatcatatcaagacggcacttgcttcctccagctctatggaagaaatatcagaggtgctggatgaaatcgggttcagaaaatatttcccggtgattttaagcggagaaatgtttcaggagagcaagccaaacccggagatttatacagagacgatgaagtgccttcgtgtggaaccggagaggtgtattgttcttgaggattctgattatggcatctgtgcggcaaaaagtgcaggtgcccatgtgatcgctcacagggaggacagattcgggttcacccaggagatggcagatcatgtggtccgtgatatgtatcatgcaaaagagatgatcagaacaaaatttaatttgtaaagtcggtgataaaattgtaagcgatcgttataacaaaaaatataatagtaatgagccggatattaactggaaaagtttctataaaggggtcatggccctcgtaattccgatggccttgcagaacctgatcaatacaggcgtcagcgcctgcgatgtgtttatgctgggaaaggtgggagagactgcgttgtctgcgtcctcacttgccagacaggtgcagtatattatgtccctgttcctttttggtttaacctccggggcaactgtacttactgcccagtactgggggaaaggtgataaaaaaaccatcgagaggatactcgctatgggaatgtgcatggcagtcgcagtgactgccatattcacgctggtatcccttctgatgcctgaaacgctgatcaggatttttaccaatgaatccgaagtgatcagagaaggagtcaagtatctgcggattttggcgttttcttatatagccatcggaattactgatgtgtatctgtatattatgcggagtgtggagcgcattaaagttgcgacggcagtatacttaagctctttgatctgcaatgtaatcttaaatgcggtttttatttttggaatgttcggctgccctgcaatggggataaggggagccgccttagcaacgcttctggcaagaattctggaactgatcctcgtaatcggatatgcaaaaatctataacagggaaattctttttcgcatgaaatactttttccatatggactccgggctgctgaaagatttccttgtgtgtgcagtccctgtgatcttaaatgaagtcttgtggggaattgccaactctgcgagtacagcgatccttgggcacatggggagtgcggcggtagctgcaaattcagtggctcaggtcacaaaagagatgtctatggtcgtgagtttcggaatctctaatgcggcagcaatttatctggggaaaaccatcggggagaagaagtatcagcatgccagagcctatgcggagcgttttgtaaaactcagcattcttctgggaatcggaagcgctgtgatcattctcttatcctctcagatgatcataatggtaatggctatgacgccgttaaccaaggattacctgcggtttatgatgtgtgtaatggcttactatgcggttgcccagaccctggatgaaactgtgatcgtggggattttccgttccggcggagataccagattcggactgatcatagacctgacggctatgtggggatgttctgttttgcttggagcggcagcagcttttgtattccactgcagtgtaccggttgtgtacgcactcctgatgagcgatgagctggtgaaaattccgatcatctggggcagatataaaaactgcagctggatcagaaatatcacgagagaaatagaataggttttatcttatcattgcacgttctgtttctatcggtaattttttagtgaatagatgaatatagtgtaagaacagagtcagacgttcgggaggcagcggaatggaaaagaggtttatgcagccggcagcgctggggctggctgtagtatttgtttccactgctttatacgcttattggggaaggccgggacatatgcatgaactgacctttctcagtaatttttctgccggtatttttctgttcggaacccttcttttaagatttgcaggaaagaatgttccgcagattctgtattttgactgcacgatgctgttatttctggtcctcatggtgtgcacggcatttaccggtcaatttaaatttaacggcttatttatgttcctgcattttctcaatcctgttttcatggtattttatttttttctcttctgcaatatgaactttgtacaaaaaagcagacagattttctctgttatgatcgctccgctgctctatctgttatttgcggcggcatatggaaatgtaacgggagattatatctacttttttctggatataaaagaacatggttatgtttactgtgtatcgtttgtgctgctgctttccgctgctgtggtgatgataggctgtgccatgttttatctgaacaaaataattttcaaaaacaggaagagtatttagaaatattgtgctgctgcatgtagagataaatgaaacttagaagatgagagcagagaggtataaaaaatcaccacggattgtaaggcagaatacataagtaaacagctgtatattctaaaagttcaggtccagaataattgattcatggatacctatttgagtttattcaatgtaaaaaaaagaatggaatgtatagatgaaagatagttatacagaaagccggcttacgccggcctttctgttatttggttcccgaaaaaaatctctcttgtatagaactccaagacactctttttgtctgttccgtggactgtaaataaatatccaggccgcaggacttcatttctgtcagcatcccggcctctgcttcactgacgcagacaggtcccaccagattaattctcccaggccctccgccaatacatccaatttgcagttcctgataccgaaatccattcatgaaggctgtatatgctctctccacatctttgaataaaacaagagtggacgtcttgataccaagtttgtcatctttccatttttgtgcagcttcttcggccgagagaatttccagagtagttcccgggggctttgccatgtcaaaaatctgtttcataaacgaatcatttttagttgcgtcatccacaataatgattctctttactccatttttcttcacccagcctgtcactacctgaccgtgaattaatttattatcaattcttactaacgatggatacatatttgtcaccccctctttttatacgtcttggcagtctacagttacacggtaagcatcaggtgcggatgctgcttcaaaagctttctggatatcttttaatccgattgttatcccttccaggcatccgctgacatcgatggtcccattacttaaaagttttgctgcctcctcaaagtcgccgatccctccgcccatggtcccgatgatttggatctggcggtaatgaatgtcatttggacttatgtgcagttcgggttccggatatcctgctgcaaatacaaggaattttcctctgtgttctctgagcatttgaagacattggtcatacgcttttgttgctcccactgcaccgatcacaatgtcggcgccttttccttttgtcagatcaaatactgcgtcagctggttccgtctcctttgcatgtatagtttcaaatcccatagattctgcacgtttcagtttcttttctgtcaattcactgacaataactcttgccccatatgctctggcggtcaatgcattaagaagacccatggtacccgccccgacaacaacaacgtcttcttgtggctggatgtgcagctttttaattccgtggattacggttcccaatggttctacgaagccggcctgggcaggttccagttgattagatactttgattgtatattttgcatctgccaatttataagttgcgattcccatatcacctttatatccgtccggtgatacggcatcaaaatcaatatttgtacactcaaatgtatttcctgcccggcaggcagggcagtctccgcagaaaatgtaaccgaaagccaccctgtctcccacaactatgtttttaacatctttcccagcagctgtaacaattcctgaattttcgtggcctccggccatagggtagccctgtttttccctaaggcccatccactgctgataatcagtagtgcaaagattgcatgtgtccaattttaccagaacttgatgatctccgatctctcccagctccctttcatgtacttctgccgtatggtcttttataaggactgctgtttttgctttcattatttaagaacactcctctccgttccttcttccaaaggggcaatctctctgtatttttttgccttgccggcggagccgaacaaatttaagtaatattttaacttatctttgtaagcaaaataggcaatgtcatcaatttcaggcagatattttccttcaaagcctgcttctatcatggcatcttttgcggcatcgtgcagatcagtaaacacatttattttacaaatatgtgttttggccgcttttccaagattttcgtcacctccgccggaacctccgtggagtaccaaagggatacttaccttttcttcgatagctctcagacgatcaaaatcaatctttggcacaattcccttattatattttccgtgagcagtcccaatagccacagccagacagtcaactccagtcctatccacatattctgccgcttgatcgggatctgtataaagagctgtatttagattgtcctcctgatctgcctctccaacatgtcccagttcaccctctacagtaactccgcaggcatgggctgcctttacaatctcagttacctgacggatattctcctcaaagggcaagtctgaacggtctgccataacagaggtgaagcctgcgtgaatacaatgcattgcctcttcgaatgtggccccgtgatcatggttaatggcgacaggtacactaaccttttctgcccaccgtttggcataatccataaatctgtaaacattaggcatataattatagttcaaaatcagagggcttccgctttcctctgcagcatctaaagcagcctgagtggaccactcataccaaacatttgaagcgcatactgcataaccttcttccattgcatcttttaataattctttcattgtcactaacattatgattcctcctttatgaaattactgccagtataccaaggctccccaaaaccaggcccacagcaagtaccatgacggcggtttttaaaaagcttttatattttcgtgtaaatagataggttccagtcaatattgccagaggaaccaatccgggtgccaatccgtccagaattttctgtactgcaaactctcctgcttttgttgttaccgcaaatggaattttaacactgataaagcctgccgccagtgcacccatcataaaaagcccgaaaacactgactgttgtgatcagttttttgaatccgccgctgccaagcagtttggttgcagattttgctcccagattgtatcctgtcatccatgtacggtaagagacaacaatctgaataatgataaaaattgtccagggtgcaagcgcagaaattacagaaccctttgctgctcccgccaggaagaggccggtcagcagcggctgcatggttccccagataatcgaatcaccgattcctgcaaagggacccataaggccggttttcactcccgtaatcatttctccttccacaggatttcccatggctttttgttcttccatggccagggcaattcctgaaattgtggaaccaagagtagcttctgtgttataaaattccagatgcctctttaatgcatctttcaggccttctgtgttgtctttatacattttcttcagacaaggaataaaagaggcacaaaaagacatacccatctggcgttcataattttggctggttgcggcaaaaatattccatagtataaaagattttcttacatcacgttttgtcaaaaggctgtgggaaacaaccggaatttcttcttcttgttcttccggttcctgttttacatatttaacagtaaacagatagaataaaaacgctatgaaaccaccggcaattgcggctccgattgtagatacccccgtgtatttgacaaggaaaaaacctataacaaaaaatggaagaagaattggctgtccaattacaaaggctacaattccaaatccaactgcgggcataatgcttccagctacggtaagaccattcataatgaagtccggaattattgtgagtacatgttttacaaacgggcttcccaggtatacggccagcgacaaagggataaagcgcagtacaatccggaccagctggggatatagaaaagcacagagatagatttttttcgtgtctcctttttctgcataccgatctgccagatgtgctactccagtcatgacaatctgctgaatattctgcagctgtcccatgagcactcccacagggattgccactgccacagcagactgaatcggcattccggattgtaggatgataggaacggcaatgagtgtagctgccgtctcatcagaggccacctgccctcccgcataaatcataccaaggtaaatgagctgaatactggctccaatcataaccccgtgagttacatctcccatgaccagtccggcccatactgcacagggaagcggtgaaaatgcaatagaaccatatggtgcaatactttgtgcgagccagtaaaacagtcctattaaaactgcctgcaatattgtgatttccatggcgttcctcctttcctgcctattcggctgtttctttaaaaacttctctaagttcttcttttgtaattcctacggtataacctggtgttgcctgccacatatcaatatctacagattctgttagttcatctacatattctgccggattcttgatccccagatcagacattttagatggaaggccaatttctttaaaaaaggtttgtgtttttaagatccctttcagagctgtttcctccggatgatcaaggtttggttcgattccccacacctttgatgcatattgcacgtatcttcccaggtttttcttatacagctttttcatgatcggcggaattacaagagcaattgtagccccatgtgtcttatcaaatttccctccgattgcctgagcagcggcatgaattccagtgtcactgattcttccaaggcccattgagccgttattggcaagactgcttgcccacataagagctgcccgtgcttcatagttatccggctctcgcagcgcgatgggggtatattcaatgacggtctttaaaaggccttcaatgagccggtcaatcataaatgtcccttttgaatttgtaaaatagttttccataatatggctcatcatatcacaggccccgcaggccgtctgaaatgccggcagggaataagtcagctccggattcagcacagcaaactttggccggattgcttcccctgcaattccaagtttttctccagtttgatcgtctgagatcacagaaaacatacttccttcactgcctgtggcagccagggtgagaattgcccctaccggaagtgatctctctgcataagtcccggtgcataagtcccatgcatccccatcataagcggctcctgcgcctatggccttggctgtatccaacacacttcctcctccaataccgaggacaaagtcagcccgttcttgctttaccaaatcaattccgtgttttacaagggaaaatctcgggttgggtacgacccctgaaagcttgcaccaagaaattttttcttcctcaagactgtctgttactgttttcaggaggccgcactctgtgattctttcggtatcataaacgatcagtactttatttttattagtatatggttttatgtagcttccggtttccctctctctgcctttgccaaaaatatagcttgttggactgcagtactcaaaattcagcattttttactcctttcattctctcatgttatatcctaccgtttcatactttacattttcatattatcctatttcgtattatctgtcaaaggattttatttccactcgatttatttagtgtatcgttacaatatcattcctgattttttgtgaatttgacacaaaaaaaggagtaccagattttccggtactcctgtggttattctattattttatctgttttctgtcagtcatctctttttccaaacttgatacataacggctgagcagactattcagtatcttttgttcgtcttctgttagtcttttatatgccctgatttcccgctctctcatggccgaaagagtctcctcagcatacacttttccctcttcagacagcttaataatttttttcctcctgtctgtggcgtgctggcagcgcacaacaaatccaagattctcaaggccatccaggattcctgtcatggtctggcgcggaatgaataaatcatctgccaattctgacggtgcgactccccccgattcccttaaaagcttatccaatacctgatagacagaataggatcttcctgttttctgacaccaagtctggcatagaaagtcccgtttccccatcagataattcaggtccagtagtcttaaattaatctcttttctatctgcttttgccatgtgtccttctttcttactgtggctgcagattcagtgcagtctccagatccacaactgtttcaggaaacagagccattaaatgagtttttaacgcggcaaaatccatagattcccgcattgtcagtgcttccatcagcagtgaaagattaactcctgcgatacatccaaacggaaatcctccataaggccatttttccaaaagcagttttccggcagtatttccgggagttcccccaaatatatccgcaaatattaatgttccatccacagatgctatactctctgctgtcttatgaacgatacctgtatattcttccaagccctggccaaatttcaagcctaatacttcaaaacatggctgttcccctataatcaagttgactgcagactgaaatccctctgcaagttcagcgtgtgtcaataataaaatttgtatcatataaaacctcctcatactaaagttccacaaatgtatacgaaaaacaggatatcctgcagtcataccctccggtatgtgcggtttatccaaaatggaatgtaaagtatagattcggcagctgtattactatttaatattatactgattcgtattatatgtcaacagaaatcaggttttctgcacttcttataagtcccgcacaggctaagatgtttcaaagatgattggtccggtgcaagccagtatgtattccagtacagaacctctgacagcagcacttttttctgtattttttctaggtcagaactttagaatgtcagacattttaggaatggattgtattatagcagggatttcgatgcttggtttttttgagaagaaataaaattaagccataataaaatacatttaaaaactccaggggacttagtcttctggagttttaccttttttacaggctgttaggatgaggcagacctgcatttccttttgaattttccgaaaactgtttgactgcagccggaagtgcagaacgaaagatcacagaaatataagtaattaattcttctttgctctgctgttcctggtgggtaatccattctactattataccagccgttgcttctgtataaaatgcagccagaaaagatttaaaatgatggggcagaattatgttcgtttctttttccgcccttttgataagagattctataatcccgacaaaatctgtgtagaaaaaccgtttcagctggtccctacctaaagagtcatagatattattcaaaaacttattatttttctctatatagtctatgacaaataagatgacttcctcataatcaacaatcaaatcaaatttctttaccacatcgattgcttcctgttccaatgtccatttcagcaaatcataaacatctgtaaaatgataataaaaagtttttctatttaccttacattcccgaataagttcactcactgtaactttagagaaggatttttggataacaatgcttttcagtgcttgggcaaatagtttttttgtatttaaacttgtaacttcatatttcatgtttaaagtccccctgtaactttaatatacagttgaccatcaaatagttcaatggctatttttctctgtttgaccatcaaattggatagatttgaccgtattttactcaatcgtggaaatatgaccgtacgattcagacaggcagttcgctataataactttcaggaacaagaaaggagataagagattatggagacatgtgcaaagaaatatttctatgaaataaatatggtcacaccggcgggaatacgatatggaagtttgcagttaaacgtaaatcaatatgatgtatctggttatcttgaaattttaaatcatcgaaaccctgtatcagggaaaatattgaaaaacggacaatgcgaatttgccgggatattagtttctctcatgcgcaaattacaatacacagcaataggaaactttgattcccattcgattcaattactactaaaaggagaaaaaaacagttaccagctatatggaaccgcaaagatcggaggaatggatgatgggatatatagaaatgaaaaatagttacaaaacatatcagatgggggattcggttatatatgcgaataaagatgtgaatttttcaattaaaaaaggagaacttgccataatattaggcgcttccggtgccggaaaatctacagtgcttaatattttaggcggcatggatacaaatgataaaggaaacgtcatgatagacggcaaagatatatcgaactatacacccagacaattaacggcttatcgcagaaatgatgtaggttttgtattccagttttacaaccttgtacaaaatctgacagcaaaagaaaatgtggaattagcttctgaaatcgtaaaaaatgcactggatcctgttcaagttttagaagatgtggggctggcaaatcgtatcaataactttccggcacaactttccggcggggagcagcagagagttgcgatcgccagggctattgcaaaaaatcctaaaattttgctgtgcgatgagccaactggtgctttggattatcagacagggaaacaggtgctgcaaatactgcaggatatgtgtacgaaaaaaggggcaacggttgtcattgttacacataatgcggcaatcgctccaatcgctgaccgtgtgatttatatgcacgatgccggagtcaaagatattaaagtcaatgctaatccgagaaatataacagaaattgaatggtaggtggcagacatgaaaaagaagaaattgtggaaagacataaaaaagtgtttttccaattccaaaggacgtttcatatccatattctctcttatgttgttaggctcctttgctttggttggtcttaaggtgaccgggccaaatataagaaaaacagggattcattattttaaagaccagaatttatccgacattaccgtgattggcgattatggaatcgacgaagagaatcagaaagtgatcaatcacttatccggtacggaaaaaatagagtacggatatttaaaagacgttgaaataaaaggctcaacagagggacttcgcttgttttccaatccagagactatttcaaactataatttaacagacggcagaaatgccagaaaggataatgaaatcgttttatcagatacttatgcaaatcaatataagattggagacacaattcaatttattgaaaaagaaacgattacaggagaaaaagttttaaagagacactcattttctgttgtaggatttgcgaaatcaccggaatttttatcttctattaacatgggacagtccacttccggatcaggtgagttaaaggggtatggttttgtcaatgatacagtctttgatgctgactattatatgttggcacgaatgactttcaaagatacgaaaggattgaacccgtactctgataaatacacagatgttattcaaaagcataaaaataaattggataagctggtgaaagatcagcccgggctgcgtctgaagaaaatcaaacaagagtatcagcgtcagattgatgatggacagagtcaaattgataaagcaaagcaaaagttatcagataccaaagatgagcttgcaaatgcgggcgaacaaatagaaaaagccaaaacaaaaattcatgcatctgatacgcaattagaaaaagcacaaaagcagttagcgtccgggcaaatacagttaaacaaaaagtggactcaattacaattggcgaaacaggcattggacagtgcaaaagtgacattacaggaaacagagacacagttaaatacagcacatcaggcaatcagaaaaggccgcgaaagtataaaggctgcagacagtgagatttctgtaaaagaaactgaacttgtccgtgcaaaaaaaacgattgctgccagtgagaagcaattagaggaaaagacttctgaatttcataagaagcagcaggaatataataccgcatatactgcattttccaaaaaaaaacacgaatgtgaatctgccctttcttcctgccggcaaatgattgattcgcttaccggacagctagccgacccatatatttctgatgaagaaaaagaaaaaataaatcagaaattaacagctgcaaaggcagagcttgagaagctggaagcagccaaaactacacttgctgaaaaggagaaggaattaaatgatgcaaagcaggaattggataatgcaaagcaggaattagagggggcagccgcaaaattgaatactgccagacaagaattatcaaagaatgaagcacagctgattcaggcaaaacaggcaatatcaaagaagaagcaattattaaaacagaaggaagctcaatataacagcggctatttgaaatatcaaaggggtatttcatcgtataatcaaagtttgaacaaatattatactggtttatctgcatggaaggattcctttgaaaccttatcttctaaacaaacagaatataagaagggtctgaaaaaattagaaaccgtgaaacacgaacttgaagaaaaagagaaagaatataaaagcggattaaaaaagtttaatgaaaaaaaagacagcgtggaaaatgaaataagcaaaaatgaagaaaaactgggtgacgcccaagagagtatgaacaatttaaccttaccggtttattccctgaacacacgcagggaagttccaggatctgaggggtacagaatctatgatacgatctctgtaattattgattctctggcaaatgtatttccgattttcttatatcttgtagctgcattagtgaccttaacaacgatgacacgttttgtagatgaagaaagaatgaactccggaacattaaaagcattagggtatacagacacagatgtcatgaaaaagtttacagtttacggtttgatttccggcttatcaggtacttttgcaggcatcgttctggggcatatattagtaccgctaattgtttataatgcttatggagcgagttttgatattccaagtatagaactgcatatttatcctaaggcagctatgactgcactgtttctggcagtggtgagtgcggtggttccggcctgtatggctgcttacagagaattaaaggaaaaaccatctgttttacttctgccaaaaccgccagctaagggttctaatatttttcttgagcatattaaacctgtttggaacaaaatgaattttacgcataaagtaacggccagaaacattttccgttataaaaaaagaatgttgatgacaatcttcggcgtatgtggggcggtaacattactatttgccggattcagtgttcagaattctatttccggaatcaatgataaacagtttggtgaaattattaagtatgatttaatcgttgcccaaaatcagaacctaaccgaagaaaaacaaaaggaaatagattcattattagacagtgaaagtgtaaaacaacaactcccggtgtattatgaatctatttcgaaagtggcaggcaaaaatcaagataagcaggaaatcaaactaattgtcacagatgatgaagcaaagtttgatgattatatctctctggaacatcgtaagagccagacagccatagatttacagaggagtggcggagcggttatttcagagcgattggcaaaattattaaatgttgatatcggtgacagctttacaatatcgaatactaatgatcaagagcatactgtaaaggttgctgatataacagaaatgtataccggacattttatgttcatgaatcatacttgttttgagaaatcattttcaaaaaagtataagtccaatgcgaatctggtcattttgaacgatcattccacaaagaatgccagagtacaggcgggaaaatttatggaatcggacagtgtaaaaggggtagtccaaaatatcacattaactaatcaaattgatacgattgtccgttcattgaataaagtcatgacagtgttaataattgtagctattctgcttgctgtagttattctttataatcttacaaacattaatattgcggagcgtatcagagaactttcaacaataaaagtacttggattctatgataaagaagtaaccatgtatatttatagagaaacaatcattctttctttgtttggcatcttagccggattcggattaggagatattctttatcgatacatccttgccgttgttccgcctgatgaagtcatgtttaatcctgcattaggagcaaaagcatttgttgttccggtgttattgattgcattaattactgtgatattaggttataccatgaatagaaaactgaaaaaattagatatgcttagtgcattaaaatctgtagagtaaaaacagcgatatttcctaaaagaggatgccttaaaattagacgcatacgcacaaggaagtaacttatatttgcagagcagcatagacgaaaggctatgccgctctgctttttctttgccgttcaatggtttgtgcgtcctcattctgctccaactccccgaaaaagttccaaatgatatggattttctgtcggcggtgtccgcttgacttatggggggcgtggacgattatctttttcgcaaactcattgacgatggtgggcgtcagttccttttgctccgtttcatactcggcggacagcttcaatgtttctttccggatatagtgcatggtgcagtcgcctgtgttgctcttataccttgcacagcggtagcaatcctgctctggggttatgttctttcccgttgcaaaatgcaacttgctcccacagtcggcacagtacagcagcccggagaacagcccttgccgttccgcttgctttgcggggcggttttgacgaagatctgagaaagatttttcaaatttcttctctcatttcatcctactacattttaccgttcatctttctcttaaaatatgtgtacacacatcatagtattgattgtaatagagcatagatacacagtttaagaaaaatagtttgtaactatttacattacaaagctgttgttgtataatgagtttgtaataatttatattacaaacaaaaggaggatacacaaatggaaacagttgtattagttggaggtaacggttatattggtcgtgagatcacgagacaatggttaaaaagaaattcggcggtacaaatttatgtaaccagccggagcgaacggcaggaaattaaagacagccgtgttcatcacattcagatagatgtaaatgacgctgccgcatttgaaaagtctttgcctgaaaaagtcgattacatcgtaaatcttacttatggaagcatggacgcactgaaaacaatccgtgattttgctgaaaaacacgactgccgagccattggaaatcttggctgtaatgcacgcgttactggttttgaggactttgtaaaaatgaaggaaaatgaattgcaatttcttcgggaaggaaaagtacgcgttgcaaattacgacgtaactattgcttatggtgctgatagaaatgatgaccttttgaaagcggttcaatccggtgcctttgatgaattaccgccggttcatgttgaaattgcagcacgacttttgattgaccgattagttaaagattggattgcatatctcaactaaaaaagtagcaaacaaacagaagcattgttaaacataaattgacagctctaaccatggggatttcgcttgtttattgtaatgcgagttgttacaataagtgaggaggtgtcatttatgagagtgagcacacaatttacgattgcagttcatgcgcttattatgattgcatattttccagatatccgcgtcaccagtgaaatggttgcggaaagtgtgggaaataatcccgtcattatcagaaacatttacgggaaacttaaaaaagctggtatattatcaattcaacggggaacaggtgctacatcattaacaaaaacagcgaatgagattactttatgggacgtttatcaagcagtagaaacagatgctgttgatgaaatctttaagttttctgatacgttatcgggtgcctgtccagtaggtagttccattaaagaattattatttattcacttacaggaagccgtcaactcattaaaagactctttgtctaaaacaacgatagaggaacttcgatttgaaatcgaaagacattataatcaaaaagttgattttgctgtcattgtggattggtataaaaagaatggttttgataccaattcatcgacaaaccaccaaaatcacggtaaataaaaaaaccgtcgtttgtatagtgaaaaaaagataagcagaggctgtaataaagttgcgtttttaagaacatggcggtatcagggaggtatcgctatgtctttttatatttgctttacgccacataacagcatgggtaagggttttatactcgtacccctctaaatggcgttctactgcgtaacaattttctgtatggaagcgtattaagggaaaagaaaagacgagcaaaaagcgttatgcttctcgctcgtctttcgcagcaacctgtttgtcagccgttaagttaattgcttccaatgatttcctgtcggcggttgcccttatggaggcattctcttttataataatattgattgacagcgaggatgaattgtgctagaatttgcctataaataggatagtgattgaaacgtaagctaaacctatgtacagaaatatttatttgaaagctgaggctttcgggtttatttgtgtacataggtttttttgtttctaagaattgacaggcaaatccattcttttgaatataatcctgcagtgataccggaaaaccggatagggaggaaggaaaatgaagatctttaaagcgctgaacaacaatgtggcagtggttctggatgaagacggtcaggaaaagatcgtcatgggaagaggcatctgttttaaaaagagggcaggtgatgatttaaaccctgaggcgatcgacaagacattttttctttccggaaccgaagcccacaataagttccaggtactgatccaggatgtcccgatggagcatattgccatcggggaggagatcatctcagaggcgaaaacgagactggggaaaaaactgaatgatatggtttacatttccctcattgaccatgtacatacctcgatcgtccggtttttggacggtgtgacggtgaaaaatgttctgctttgggatatccgcagattctataaagatgaatatcagatcggactgtgggccctaaacttggtcgaagaaaaatgtaaggtccggctcccggaagatgaggccgggttcattgcattacatctggccaatgcccagatggatgacgacacgatgcacaacatgtatgaaatcacccgaattatgcaggaagtagtcaatatcgtaaaatactttttcaagatagagtttgacgaggacgacgtttattattaccgttttgtgacgcacttgaagttctttgcaaagcgtctgatcgaacacacggcttatgaggaagacagcagtgacggcctttgggaagtgatcagagaaaagtatccggaggctttccggtgcactgaaaagattacgcagttcattgcaggaaaatatgaatatgacctgtcaaaagaagagcagctttacctgacgatccacattgagcgggttatgaacaaaacaaaaaagcaataaatttcaattatcatgtacgccaggatggtgacatttggttggccaaaccttcataaatataatttcaattaaatggaggtaagaaaatgggtaagtacgaaacactggcaaaagaaattgtcaaaaatgtaggtggaaaggaaaacgtcagcagccttgtccactgcatcacaaggctcagatttaaactgaaagacgagagcaaagcgaaggatgatgtgctgaaaaacatggacggcgtggtcacagtgatgaaaagcggcggacagtaccaggtggtcattggcaatcatgtgccggatgtctttgcggaggtgatgcccctgctcggactggcagaagaagcagggcaggaggaagacccagaaaaaggaagtctgtttaacagggccattgatacgatttccgggatttttcagccgatccttgggatcatggctgcctgtggtatggtcaagggtttgaatgctctgtttgtagcattgggtctttactcagatgcctgcggaggttatcttattttaaatgccatcggagatgggctgtttaactttctgcccctgttcctcggctacacggcagcaaagaaattcagactaaagccaatgctcggcctggtgatcggagccatcatgtgttatccgaccattcagaacagcgctttgtcagccggaggaaatgctctctatacactgtttggcggaacaatgtttgcatctaaagtttatacggatttctttggtatcccattaatcggcatggattatacagggaccgtaattccagtcatctttgtcgtctattttgcttcaaaatgcgagaagttttttaacaaatttatccccgatttagtaaaattcttttttgtcccgatgctcacactgcttgtggcaatcccggcaggactgctggtgatcggacctttagcgacttttggatccaccattattgcagaggcagttatgactgtcagaaatttcagcccgatgcttgcaggagccattgtggggcttacatggcagattctggtgattttcggcctgcactggggcttcattccggtgtacatcaataatattatgacaaatggtttcgataacgttatgatgccgttttttgcctgcacttttgccacatcggcagtcgttctgggtgttttctttaagacgaaaaataaacagatcaaagaaatggcaatcccaaactttatttccggtatctttggagtcacggagccggccatttacggaattctgctccctttgaaaaaaccgtttatcatcagctgtatcgtgggaggcatcggaggaggattctacggagcctttaatttcagaaagtttatgatgggaggcatgggtatctttgaattcccggcaatgatcgaaccggacgggagcatggggaacttaatcgtagcagtcgttggtgtgatcatcagcatggttttgggatttgccgcgaccatgatcttttataaagaaaagcaaccagccgttgtacaagggacagaagaccaggacaaggatcagctggaaccagaagttacggggcaggaaaaaatcatgaaacagctggaaattgcaagtcctatcaagggcaggatattaaaactggaatccgtcaaagatgcggctttcgcatcaggagttcttggaaaaggggcggcggttttgccagaggaaggaaaagtttatgcccctgcatccggtgtcgtgtcagccttattcccgacactccatgccctgggaattgaaaccgatgacggagtacagatcttgattcatattggtctggataccgttcagctaaacggagaaggctttgaggctatgataaaacagggggaccggattgaaaaaggacagctgctgatcacctttgataaggagtttatagaaagcaaaggctattgcgtcgagacacctgtactggtttccaattctgatgactttctggatgtggtggaaacccgcgaagaatatgcagatgcaggtgacctgttattgaatgttctgaaataggaggatgagcacatgggatttccaaagaattttttatggggcggagcaacggcggcaaaccagctggaaggcggtgtatttgaaggcggaaggggtcttgcaaatgtagatgtttgtccgtccggagcagaccggtcttcggtcatcgcagggcaccgaaaaatgcttaaaatggatgataaacacgagtatccggcagcagaggctgtggacttctatcatcactttcgggaagatatccgcctgtttggggaaatgggattcaaggtttaccgtctgagcattgcctggaccagaatctttccgaatggagatgaacaggaacccaatgaggagggactgcgtttttacgaagaaattttcaaagaatgcaggaaatatcacatccagccattggttacgatttctcactttgactgcccggtctatctgattgagaagtatgggggatggagaaacagagaaatgattcgtttctatctgcgtctctgtgaagtgttattcacccgatttaaagacgatgtcacccactggctgacatttaatgagatcaatatgatccttcatgcaccatttatgggagcaggcatttactttaaagacggtgaaaatgaggaacaagtgaaatatcaggctgcccactatgagctggtggcaagtgcgctggcgacaaggatggcccatgaaataaatcctgaaaataaggtgggatgtatgtttgcggccggcagcgcttatccgtatacctgcaggccggaagatgtctgggaggcactgcttactgaccaggaaaattatttctttgtggacgtacagtccagaggatattatccgtcttatgcggtgaagaggcttcaaaaaaaaggagtttttccagtgatggatgcaggagacgcagagattttgagagagtataccgttgattttatttctttttcctattataacagcagatgcatcgcggcaccgggaggcggacaggaggaagcagaaggaaatctgtttaagtcggcaaagaatccttatctttcttacagtgactggggatggccgatcgatccgctggggctgcgcattacgttaaaccaggtgtatgacagataccaaaagccattgtttattgttgaaaatggattgggagctttcgatgaacctgatgagaacggttatgtggtagatgattaccggattgaatacctgagggaacatatccgtgccatgaaagatgctgtggaggaggacggagtggaactgatggggtacacttcctgggctcctatcgatttaatcagtgccggaagcggggagatgaaaaaacggtacggatttatctacgtggacaaacaggaagacggcagcggaacactggccagatcaaggaagaaatctttttattggtataagaaagtcatagagacgaacggggaagaattgtaattagctttctatatgttcttcaaaggtgtcagggagctcaaaacaagaggttcctgacacctttttctttgtgttaaaatttccttttctgaaggatagatattttcacaaaggttaaggccagaccgtaaataaacaaaagcagtacagcaggaaatacttttattcctataaaatagggttctttggcgaaggaatccggaagaaatgaaatcggcggtacgatccaaagaataaattttgagacgggaaatgccgccgtcagagaagttttgatcactgatactatgtcgacaagtgtaatcatgagtaaagcagatttcctgtcttttatgactctgggatgagacagctcacccagactgcatcccataaatgcagaagaggacagcagaaaaaatccaaatatgatatcttcaggcagcagctttcggtcaaacagcatctggctgttggacagattgatcaacactgggatcagcaggcaaagcagagcagtcagcatgctgaggcttaaaagaaacagggcatgtccccaatcgtatttattcgtgctgcgcagtctcaagatcataatctgttccgacgctgtatcttccaggctgcagacagaggtaccgatccatgatgaaatcagaaaaacaaacagacagcagctggccaggctggccaccacactcaccggttttgttgaatataaagtaaacagcatcacaacgaaagcggcaaatggcataacaaatttatttgacttcaaatactgcaggtattgatattttatgagaccgctaatgatccgcatcttccatcctccttaaaagccatccttcctgtatcatatatgcgatcacaggattgctttccgattcttttacttctattctatatttaccgcagcagcttttgattcgtcctgtacacagatcaggaatttcagccccttctttcttatcaaaccatagaatataatgtttttctgccgcattttccggactgtctgccagggataaatgtttcctgtcaatttgatacactgtgtcactgatactgtcaatcagatattgttcgtggcaggacataagaatagtcattcctgttctgcgcagttcatttattttttgtatgaacacatcctgagagtctgtgtcctggccggacagaggctcgtctaatattaaaacatcaggagtttttaacagagcctgtataactgatactttctgcaacgttccttttgataaatgttttatcgggatatccagcatatcagataaaaagaattcttcacacagcgccttataccttgtctttacatcctcagtactcagaccatccagatatcccatatgccggaggtattgtctggccgtgagattcattttagggaaccgctcaggaacatagtggaacagaggagcaccgtaatataggacattcccatgtgtgggacgtattagtcctgcgagcagttttaataatgtactctttccgcatccgttgtggcccgtaaaggcgatggattgattttgggatatggaaagggtcagatcctgtaagatgacctgtttgttatatgattgcgtgatgttttttagttctaatagatggtccacaattctccccttatctccgatatggtatgattcatataaattaactttgtaaatattgtaacagagattatgctggaaagtaaaaaaattcgatttttcagggaacatttttttatgctatgacattatataagtgaaagggttaagatccgaacaagattttatagcagaatggaggcttttgttatgacgacagaagagatggaagtactagtgaatgaatatgggacatccttgtatcgtttctgctgccatttgaccggtaatgttcctgaagccgaagatctgtatcaagacacctttctaaaaactgtcgagttaagccacaaactcgacagatgtggcgatggtaagagcaaacgaaactatctgattgggatttccgtaaatctctggaagaataaaaagaggaagagcttatggagaagaaacattgtttcagagacggaattcgatgatttgagagcagccgacaccagaaatttaggcgggcttgaagaagcagttgtcaaacaggaactgcttgatgaagtgaataggctgatcggcagccttcccgaaaaacagaaaattattatgaatatgtattatgcagctgaaatgagtatcgaggaaatatcagacaaccttaaaatttccaggaaaacagtcaggagcagtatgagcaaagcgagaacgaagatcagaagcagtttggaggcgagtggttatgaaatatgatttggaagaattaataaatgaaacatataagaataaacaggaacctcctgaacagctgaatatctctgttctgaaaaaaatggaggaacatgttatgaagaaaaaacaaaaaacaaacaaaatgatgaaaattgcagctgcggcatgcgctgtattactgctggcgattccggcaggagtcattgcagcacctaaaattgtgaattattttaaaagtgaagttaaaaaagatcagtatgctgtagatatatctgtaaacacggagcagaataaaaaattgaaaaagaaaatcccttatgtatccctttcctatcatttgccggacaaataccgtgagggaggttcagggttaaaaggatggtatgaatttaaccacaagtctggggctcatgccggaaaagatttttcattcgaactggtacaaatggataagtccgtggacaaagattattatgtcgatgatgtaaaacaggcggataacttaaagattagcggacataaagcgatttatatgaaccgatattatataaaagacagcagatatatcaaaaatgacacttataataaaagcatgtttgtattttatgaagaatatggctatatgattcggtactatgcgatgtctggtgtaagtaaaaaagatttgtcaaattttgcgtcccaggtaaaacttaagaaatgcaaaaaatctgaggcttcaggctacgtccgactctctgagaagacacaaaagaatttacagggacaggaaagaggaaaagatacaaaaataaaaggaattttcaaaaatgctggagacaatgtaaaatatgatgatgctgagtatgagatagcttcagtgggaatcaaagacgatatcagcggattatacggaaaaggtttttcaagtactgttgatcttcaagaaattttagataaaaatggtaaactaaaatcatacagaagagaaactttaaaagatggtgacggacgccattctgcatcaatatcagttgcagatacaaagactgtaaagcagaagatggtttatattacaatgaagataaaaaatacaggaaaagaggaaaaaataataaacgtgtgcaggcccctcacttatttgagaaaaacaaaagacggaagctggcgtatccttgaggaatacaacagaccggaggcttttaggaattgtcagttagacaagtgtgcccaatattttcaggagacagacgggggatatcgtttttatcttaaaacgttgaagccaggacaggaagagatttatcatattggatattttgtagatgaggatttactggacaaggcctatatccaaatagatggtgggggagacagtggcaaagataacacaggctatataaaaataacaaagtaaacttattagatataaaaagagattactgtcgtataaattgatacggtggtaatctcttttattatggcctttttttgtgagagtgatataatggaaatagaatgaggagtaacataattacatatttaggagggagagagttatgaaacaaattctaaaaagatttctttgtgtacttttgactgctgcagttatactgacaggaaatgtttatcatacccctgaagtaagcgcagcggcaaatttaacttggggattatctgttggtgttaaaagacacaagcagctggaattgtctgtttccaatgtagatgcagcacagactgttacggcgcatattacagctggatcagatgtttttacaaaagaacttgagataacaagaagatcccaagactttgagatggttctggataaaggttataagtcaggtacaactgtgagtgtctatcttgaaactgcagatcataaaaagaccatgacagcaactcatgagataaagcctgatgatttgtatctgtcagacacagaggcaaggccgaaaaggtttactgcaaaggcatatagtaagggaatagttaataaagtttctgttgaagctggaatcgggaatgtatatgagggacaagttgatgaggatggaatgatccgagtggactatcctatacaaaatgtaggagacaaaatacaggttacttggggagacggatattgccaggagacaaaagagtttaagatagaaaacagcgacctgtatattgcgagtttgaaggcgaccagaagtgagatttctggatatacacttcaaaatgatgtacggttacatgcaaaaattaacggggtagattattactccatgtatggaagagatcataaaagcagccagccatttattaaatatccggttcaacccgttggacaaaaaattgatttgtggttggaggcagaagatggaagcattaaacaattggaaacacttattattgaagcatgtaagttatcatggaaagatacatggttatgggatagctatccaaagcggacaatagctgaggttcctgagaatacttcttatgtaattgctagaatcggaaaaaatgaatatcgcagttctgttcagagacaaagctgtactctgaattatcctgcccaaaaggaaggaacagtcataactttaacagcatatgatgctcatggatgttccacagaagaaataaaaaaaacagttgaaaacagcaatgcaagaaataaaacagaagaatacttttctcatgcgggacccagcagggcacgcgggaaatcaccattttatgacagattatgtgccgaaatcaacggaaaaatttattatggtgatcttccaaaacatagttctgaaatagtgtacgtttcatatccgccgcagccggttggaaccaaaattaagttttggtatgagacagccaatggaagttatacgaataccattactagaatggttgtgaaaaagaagaacgaagtaacaatcaaagatttatctgtaaatcgcatatccggaagcttatatattgatcaagattattatgcagaactagccggtattcgtgccacagttaatggaaaaacctataatggaacagttaagtataatgaagatatggaacgtgtctatactatatcttttcctcagcaaaaagtaggatcaaaagttacagtcactttggaggataaagacgggtataaagtatatgcttcctctacgattaaaaataaaccaataaaatttaatataaacagtggtacggagtatgcagacggcttaatgtggggtgaaacacttcctaaaacaaagataactgtaaaaataggaaatcgcacatataacactactgcagacagcgatggagatttctttattgttatccctgttttcagaacaggtacgaaagtttatataaaagcagttgctccaaacggatactataaagtaattaacacgtctattaagaagtcctattgcaaagtaaaggttaaaaatactcagtttacaaaaacaaaatatgccaacattcaatgtacaggggctaataaaggggaaaagcttaagattaaagtcagcggaaagactataacgagaaaatttaagagcaacaactataagcagtcatttaagatcaaactcccgaagaaaaaagccggaaaaagtataaaggttattatttatgacaaatatggtgaccaaagagcaagtacgacaaaaaggatttacatcggcgggaccataaaagtaggaatgtctgccaagaaggcagtcctgactacctgggggaaacctgtttataaaagaaaagcaaagaagggctacaaagaatggggcttcattcggggaaattatggtctgattgcattaatcaagaaaggcaaagttgcaaaggtatataaaggcagactgaattaagggataaagaagatcatagattataaaagcgaaaaaaccttccactggctggaaggtttttttcgtgattttatttataaattgtttatattttatatgttttttgtgagtttttaacatgaaacaccgcaggtttgttaaatatcaaacaaaaaaatctatttaatgaaaggtataacaattatttactggtagcatttgcccaattttctgaaattcattctgaaaaaaattaaaaactccctctttactttccacatcgtgtatccgatacaatgaacttaacaaataacagaaacgcaataagaaaggagcaactatgagtgtaataatggccaacgccatcggtaccgggattttctgctgtctctggcagggagtcggctctgccctggggctcgccacatggatcggattcgtcggatgcacgtcatacttttccgccggatgtgggaagacagggttcatcaagtcgatgtgcagcaactacacaggtcttctgtggggcatgctgatcatcctgtccggcggcatcaataacacgatcatattcggagcagtcgtaacgggattcttttcctggctgatcgtattccagtcccacattgatgttttgtctctggtacccaatacgtttatgggaggtttttctgcattcgccagcggcggagattggaaaatgctcttaatctgtcttctgttaggcaatattctcggagtgtcctgcgactattccggaagattcctttttaagaaattcggaaaagaatagtgccggctgaacgtcccaggctcagatggaaaaccatgaaattgatcatataataaggagtgtgaaacaaccatgagtaaaattacaaaaaaagagtatggagaagaaatggaaaagggctttaatttaagaactgcaatggaagaagcatccagatgtcttctctgccatgattcaccctgcagcaaaggatgccctgcaggaacagatcccggaaagttcatccgttctctccgtttccgcaatataaaaggagctgcggagacagtccgcgagaataacccgctggcaggatgctgcgctcaggtctgtccatacggaaaaatgtgtgagcaggcgtgcagccgtaccggcattgataagccgatcgagattggaaagatccagcgtttcctcgtagaagaagagaaaaaccagggaatggaattcttaaaagcggctgagccgaagaaggaaaagattgcctgtgtaggtgctggaccggcctctctttcctgtgcaagacagctggcgttggaaggatattctgtgacggtctatgaagctcaggacaaagcaggcggtgttcttacatatggaattattccaacaaggcttcctcaggaagtagtggattttgatattcagaccattgaaaaactcggagtagaatttaaatttaatgaacccatagatgcgtcaaaacttgaggagctcaaaaatgattacgatgcagtattcgtaggagcaggtctctggaaatcaaagatggtggatataccgggcaaagatctggaaggtgtggtaactgccattgacttcttaagggaagctaagacaaatacagatcagctggtacttggagaaaatgtaatcgtgatcggaggcggagacgttgctatggactgtgtcacgactgcaaaacaactgggagcgaaagcaaccatcgtttaccgcagaaccattgaagaagctccggcagatatggatgaagtcagcttcgtacagagtatgggtattccgatcgtacaggaatttgcaccggcagaaatcgttggagaaaacggacatgttaccgcaatgagatttgaaggacgtgacggagaatccggactgaccatgaagaccgatcaggttgtgctggcaatcggccaggcagtcggagacgacgtggcagacattgcagccggcgaaaatgtcttcacaggcggagacatggtaaacggcggaaaaactgtagtagaagctgtcgcagaaggcaaagaagccgcagaaaagattgcagactattttaacaaatagaaaggaggcattgaatatgtccgtaaagaaagatttatccatcgattttttaggagtcaaatgtgaaaacccatttttcctctcatcctctccggtgggaagcaactatgaaatgtgtgccaaagcgctggaggcaggatgggcaggagtttactataagaccatcggtatatttatcccgaacgaatgctcccctcgattcgatatcacatcaaaggaagggacaccgtggactggatttaaaaacatggaaatgatttcagataaacctctggaagataacctggaatacatgagaagactgaaacaggactatccgacaaaagttatcgttgccagcattatgggaagcaatgaagaagaatgggagatcctcgcaaagaaagtaacagaggccggtgtcgatatgatcgagtgtaacttctcctgccctcagatgacatcctctgccatggggtctgatgtaggacagaatccggatcttgtgcgcagatactgcgaggttgtttccggtgccactcatcttccggtcattgcaaagatgactccgaatatcggaaacatggagattcctgcaatcgctgccatggaaggcggagccaagggaatcgctgccatcaatacagtaaaagccatcacaaatattgatgtggaaaatatgaccgccatgccggtagtcaacggtaaatcatccatctccggctattcaggtgcggcagtaaaaccgatcgcgctgcgttttatcacacagatgaaacagcatccggaattaaaagatgtcccgatcacaggaatcggcggtattgaaacatggaaagacgcattagactttatccttgtaggatcttcaaaccttcaggtaacaacatccgttatgcagtatggataccgtattgtagaagatatgatcagcggtctgtcccatttcatggaagaccatggaattgataaattatctgatctggtaggcgtggctctgccgaacatcgtgcctgctgatgacattgaccgtacgttcatcctctatccggatttcaataaggataagtgtgtgggatgcggaagatgctatgtatcctgctttgacggcggacatcaggccattacatgggatgaagaagagcggaagccggttctcaatgaagataaatgtgtcggatgccatttgtgcctgaatgtctgtccggttatggactgtattacccctggaaaggttgagatgaagccgggagttgaagaccatgaagtgaaaatgaaaaccaagtatgagtaaagcataagtcagattgggggacaatcatatgaaaaaattcgacttagtgatcaaaaacggtactgttgtgacagcttctgatatgttttctgcggatttaggtgtgaaggatggaaagatcgcagccattgcagagaatatagaagcagatgcagaagaagtgtttgatgcggctggaaagctggttcttccaggagcactggacgtacatactcacctggcaatgccgttcggcggtacaatttcttccgacagttatctctccggaacaagggcagctgcctgcggaggagtcacaacggtctttgactatccggttcagcataccggcgaaaccatccgcggagtcattgcagagaaaaaggctgttttggaaaaagaagcatgtgttgattttgcatcccactgctgtatcacggatctttctgacggagcgatcattgaggagatggaagaggccgtaaaagagggaatcacaagctttaaatgcttcctggtgtataaaaaagagggatggatggtaagtgacggaactcttgcgaagctgatgctgcgtgcgaaggaactgggtgccatgatcaacgtccacgcggaaaatccggatctgattgatatgtatacggagcagtttttaaaagaaggcaagacgagtgcctggtatcattacatgagccggccggaatttgtggaggctgaggcagacaaaagagccgtacattggtcaaaacatttagatgcaccgctgtatcttgtacatatggcagacaaagaaggtttggaggcctgcattcaggcaaaagaagaaggagcgccagttttcgtggaaacctgcccgcagtatctggaatttaccagcgatgtttataagagagaagacggacgcaacttcgtatgctcccctccaatcaaaggacaggagagccaggacgcattgtggaaagcaattaagaacggatctattgatacggtagcaactgaccactgtccgttccagagctatgagaaagactggggcagggatgatttcaccaagattccgaacggatgctcaggaatcgagaacttatatccatatatgctggatgcggcaaactccgggaaaatatctttttcaagggcagtagagctgtgttccacaaatcctgccaagattttcggatgtgatcagaaaggttcgattgcagtcggtaaggacgcagatattgttatttacgacaaagacaaagatttcacgatcagtgttgatacaatgcattcagactgtgatcacacgatttgggaaggaaagaaactgcacggataccctgtacgtactttcctccgcggaaatgtcgtctatgcagacggagaatttaagggaactcctggcatgggtcagtttgtaaaacgaaccccaaaaaaattacgataaaaaagagagggtaacatgggtaaggcggttactaaaaaggatgcagaacagatgcttgaaaatgcattggagatcggagcccgtatgctgatctccggagcagagatcaggcgcgtggaagattccatctttagaatttgtacggcctatggatctgaacggactgaggtgttttctattacgtatacaattgttgccactatttcctccaagaatttcggtatcataacccagtccaggagaatccatggttcggcatttaatcttcaggaactgaaatatctgaataacctgtcccggaaaatatgccggactcttccggatatggatgaggtcaagaaagatttagaagagattcacggtctgcccacgtacagcaaccggcaggggatgctcatctatgcattgatttcatctgcctttaccctgtttttcggaggttcactgctggatgcggcgatctctgcggtcataggagtcatgatcaagatcgtggagatccctttgaaaaatatgaatatgaatcggtttctcgtctcctgcctttgttccctggcagcaggggcactggcagtcatggcggcgcgtacaggtatcggctgttcttctgataagatcagcatcggaaatgtcatgatcctgattccgggacttatgttcacgaactgtatccgggagatgatatccgataattttttatccggcctgacccgtttcggagaagcggtcctgctaagcctttcgattgccctgggctttgcagtggtcagctggctgtgaatttgagaggagatgagaatgagcggattaaatcagatcatagcagcatttttcggtgccctcggttttgcttttttattcaatctgcatgggaaagagatattttatacttcattaggaggatgtcttgcatggtgcgtgtatctttcggcagggctcatcatcccacagtatgggaaacaatattttgcagcggcattatttttagggatttatgcggagttttttgcagtcaggacaaaggttcccgcgacattatatcttgcggtcggcatgatccccctgatcccgggagcagcattatttatgatgatgcagaatgcatttaaagccgactgggaacagtttgcgcagtatcggttagaagcatttattacaggagcttccatagcttccggaacaattgtggcagccgtgtgctggaacatttttaagaactattggtttaacaaaaaataaggaggttcatttatgtatacatgtgatttaggccggatggcggacaaaattacaactatgagtaaatatggggatgccggacacggaggtatcacaagatattctctttcaccggaagctttacaggctcgcggagaattcgttaaaagaatgaaagcgatcggagccgagattaaaacagatgatatggcaaatatctatgcaacactgaaagggtctgagcctgatcttccaaacatcgttatggcttctcactgtgattccgtaaagaacggcggaaattacgatggtatccttggtgttatgggagcaatggaagtgctggaaagcattgcagatcagaagattcctcataaacataatattacggctatgatctggacaaatgaggaaggatcattatatccgccggctatgatgtcttcaggggtgatttgtaatgattatctcccggatgatatcaagaaaaactttattcatgaaaatatgcttgcctccaaatctgttttagatccggaaaagacattcggtgaggcgctggaagcttcaggatataaaggagcaaaagaaaaccgcctgaacaataaagattatatggcaatgtttgaacttcatatcgaacagggaccaatcctggaagcagcaaagaaagatattggtgttgtaacatgtgtccttggaatgatcaactataagatcaaagtttacggacagtccgatcatgcgggaacaactccgatgccttaccgccaggacgctttatatggagcggcaaaggttcttcagtatctccatgatgagctagataaactggattccgaattagtttatacaaccggagagatctactgtcatccgaatgtacataccgttattcctgattatgtagaattctctattgatgcaagacatgagaaaccagaagtcatcgaacaagttgtaaatgtcatcaagaatatgccaaaagaagttgtgaaatgcaaagtagattatgaagtggcatggaccagagacacggtttattatgacaaagaactggttggttatgtacaggaagcagtcgatgaacttggctactccaatcagaagatcaattccggagcaggacatgatgctcagtttgcagcatacatgatgccgactacaatggtgtttgttccttctaaggacggacattcccactgtgaaccggaatatacatcaccggaacagtgcacgcagggagcttctgtactcctgaacgcagttctcaaatgtgatgccgataagtaggtaacattgttttcctttacgttaaaataagcagaaagaacgctgtgaatttcagcgttctttttgccgctctattctggtataatagcattggcatttaaaatgtactgagggaggtgtttcatatttttatcgacaagccttattacagcataggggaactttcggcgatctgcgatattccgcagaaaacactgagatattatgacgagatcggcctgtttactccggaccgcagaaacgaggagacccattaccgcctttattcaaaggggcagatcattacggtcgttatcattaagaatttgaaacaaatggggttttcactgaaggagatcaaagagatcgtctctgaaaatgaagccaaggcgttagaaaagaatatgctgaaaaagctgcagtctatgaagcaggagattgaagacagtatcaaccgatatacggaatactgctattttctgaaaaaaatacagagcggaattgatatattggaagaactgtctgacagctgttctgacgagatgaagatttccgtagaatttattccggagatcaatctgttatatgaccgccgtatcatgaaagattatgattattctgaaatttcccttgaacggtggcttggaatcacggataaagcaaagaccatgaactgtaaaattacagggccggtatatgtcactttttatgacagtaatatactgaataaatttctgtcccaggactctgagatcgaatttgccgtccaggtagaggaatcaaagcccgctgaacatatacggccttttggaggaatgctggcggccacagtcattcatatcggaaactatgaagacatttcaagcacctacatacagctcatcaaatggatcaaaaaacataattatagaacggcaggaccggccactgaagagtttatcctttcacctctggatgtgaatgatgaagccagaagggtcaccaagatcatcatacccgtagaaaaagactcttaaaaattactttgtcacaggaatgatgattttagtaacatgttcattttcatttcgcaggtccacaggggaaataataaattcttctgaaaccggacctgcaaccttatagtgattctgattgatccactgaataattttgatgtgggtcctgattacatcgctgtacgggccgacatgaaaagcggtagctgccagaaagccgccgaactttcggacatgtttggaatcgctttcttctacctggatgccgaactcaatatcacagtctttagaaagaaactggtccagcagatccgtgtaataggtgactgttatcgggccgcataccttaaggccgtgtcttgagacttcatcgttgatctctacccaccgctcaagggagacctcgtcattgtgataagactgcatgatcctgcgggagtgataaagatttacttcaggcacttctttgaccgtgattgcatccatctcaccggcctggatctttttcagatcatcatcatagagatgaaggatctgggcaccttcttttaatctctgtaaaaactgctccccctcaaagtatttctgattcagagtttcaatttccttttttatacataccagtttatcttcaattttctgttccaggtttcggacctggtttgcagaaactatttctttgatttccttaatcgaaaaaccgagcatgcgcagtttccggatgatagaaatggttaccatttggtctttgctgtaatagcggtatttgctgtcttccttccggacctccggaactaccagcttaatctcgtcatagtaacgaagcgtcttaatagaagtgttacaggtagctgccacttccccgatagaatagtaatgattcctgtccaaaattttgtccctccacacattttatcctttagaaatagtataccttatcgcacgaagtgcgtccacccgaagggcataaaatacggtgtgttacatggatttgtaaaaagttgtacactgataaagaaatatggtataatatgtataaataaataaaaataaccaaaaactaaatgaatataaaatttattacttacaaagtaataaatattgctaaaatggagaaattcgtctataatgaaaatatattatgataacaaaaatatacaaaaattatgtaacgattataaatatgctcagaaaaaattaggaaaaaatgtcgcgtataaattacataaggcgttacaattcattaatgcatcggtatgttttatagatattaaatatatgatgactcttcgtttgcatcctctaaaaggggacagaaaaggaacatatgcgatagatctagggaaaaaaactggatttagattaattttaataccagttgatcagaatggaaacaagtggacaaatgaaaatattattactatttacaactcaacagatacagtaatcttaatggaggtgagcaagcattatgaatagttctgaatataaacaaagcattgcatttcacccgggagagtatatcagagatcttatcgaggagatggaagttacacaaagtgaatttgccagacgtttgaatgtcagtgaaaaagttttgagtgagtttgttaattgcataacgccgatgaataaagatattgcggaaaaacttgcaacaatgactggtacctcggtaactgtttggttgaatttacagctagcatatgacgcagctgttttgaaaaatagaattgatcaggaaatgaaagctgacgaagcaattttcaatgtacttgattatagttactttgttaagctcggggtagtgagcaaatgtcaacaaaaagaggaaaaaatcagagagctaagaaagtattttacagtatcatcacttggtatacttgctcaaaaggattttcttgttaatttcagagcagtgacatcaaaagaaagtaacaaaaatattatatgtgcaaatgcatgggttcagacggccattaatatgaccaagaatattaaaacgaaaagctataatccaaagaagctgagatcattgctgccggaacttcgtaagatgacattatttcagaatgataactttgtttcaaagatgcaggaagtattagcagaatgtggagtggcagtaatttttctgcctcatctaaaaaattcagacattcatggagcagtcaaatggatcaataatgaaaaagtaatgttggcgattaatacacatgatgtatatgcagatatattctggttttcatttttccatgaactgcgtcatattttccagcataaaacatcgaaaacatttatagtgtcacatgataataatgaaatgggaaatgtagatatgaagcttgagaaagaagcagatttgtttgcggcgaatttattgattccccaaaataattttaatgaatttataggtgattccgaaattaccagagaaaatatactcgcttttgctgataaaattggaattcatcctgggattgtggtggggagattacagcatgataggtttgtggactttagttcgctgaatgatttaaggataaaatacaagattcaatagtataatcttgtgttttgtaatgttgtatagtaaagacaactaaaatttatagagtaggacttagagaaatggatcatcagaatattgaactacggcattcaatttcaccggaaatgttttgcagattacgcgaacaggtgaattttcaaaaagtatcacagaggcaggctaaaaagattttagaaaatacaagttacatctgtgcggtattttacaataacgaacctgttggagttacacgtctgctttttgattatgggacagatgcctacattacagacgtcattgtaaatcccgattatcagggatgtggaattggaagattattaatagaaaatgtcttaaattatattcggcagaatgtaacagatacaaaagtggtatgcagtctgtatgcaaatcagggaaaagaagatttctatcatcgctttggttttgaaaagttaccaaatataaaatatggctatggaatggttcttgatgtataaaatcttgattttattaaaatcttcaggacagcagatataaaagacccggcagacagccgggcctttgacttttatttctcagacttaacggaataaacttccgctgatgacaagcttctgaatttcattggtgccttcatagatctgtgtgatctttgcatctctcatcatgcgctctacatgatattctttcatataaccgttgcctccgagcatctgtacagcttcctgtgaaacctgcatagctgcatctgtacataccatttttgctttggcagcagagatagagtaactgcgtccctcctgtttatccatggcagccttgtaaagcatatattgtgcctgctcaatctgtacagagagttctgccatcttaaacgccaggtactggtttttgcataatggtttaccaaattgctggcggtcttttaagtactggagtgcgatgtcataagcaccttttgcaattccaagtccctgagcagcaacaccgattcttccgccgtccaagtctttcatggcaacagcaaatcctttgccttcctcgcctaccatattttctttcggaactcttacattttcaaagataatctctgaaacctgagcacttctgattccacatttgttttcgatcgtgccgacagaaactcccggcatagctttttctacaacaaaggcagataatccttttgttttcttttccggatctgtcagggcaaatacaaggaagtagtcagccagaggtccgtttgtgataaagcatttcagaccgttcagcacataagcttcgccgtcccagagagcggttgtcttacatccggcagcgtcagaacctgcttccggctcagtaagacagaaagcgcccatctttttaccggacagaacatccggaagatatttcttcttgagctcttcgctggcagaattgatcagaccgccggagaagagagaagtacatacagaataagcaattcctacggaagagtttactttggagatttcttctacggctaatacataagagagatagtcggctccctgtccgccgtattcttttggaaatggaagaccgatcaggcccatctgtcccatttttgcataagccttttcagggaatttcccttcttcatcatcttttaatacggttggaagcagttctgtctgagcaagctgtcttgtaatattctgaatggataattgctggtcggttaattgaaaattcatattgaaacctccttctgtgtgagtttggcgatcattgccggaatcacatcatttaaatctcctacaatcccataatcacagatgccgaagatcggcgcttctgggtctttattgattgcaacaatatattttgattcattcattcctgccagatgctggattgcgcctgagataccacaggcgatataaatatccggacgtaccgtggttcctgtctgccctacctgatgggaagcatcgatccatccagcctctacacaagctctggaagatccaacttccgcaccgaggacatcagctaactcttggatcaaatggaagccttctgcagattttaatccccggcctccggatacgatgatccgtgcgtctgtcagatttacttgtttcttttcttctttaataatttctacaagcttagctctgatatcattttctgagagatccggaataaaggtttccattgttccggcagccgtttcctgatggatggctttctccatgactccgggtcttaccgtagacatctgcggacggttctttgggcagacgatggtggccataaggttccctccgaatgcaggccttgtctgcagaatttttccgtcttctgcatcaatctcaagttttgtacagtctgccgtaagacctgttccaagccgggcagcaattctcggtccgatatcccggccgatggacgttgcgcctaccagaacaatttcaggttttttcttctggatcagctgtacaaaagcggaagtatagccgtcggttgaaaagcttgaaagcagcggatgtgacatatagtaaacgatatcagcgccatagtgaagaagcttttcaacttctgattcaattttgtaacctggtattacaacagcgagttttttctgaagctgatcggccagcttgcggccttctcccatcagctcgattgtaacgggctgtatttttccttcccgttgttctccaaggacccagacatcttcatatgcactcaggtcgattccctggtttacttttgctcgttccattttctgtcctccttaaatcaaatttgcctgcagaagcttctcaataagggtttccgctttttcagaatccgtatttccctcgatgatctcactttgtttcgatttaacagggacaaaggaacggtaaacgttagtaggagaaccttttagtccgatctgagtctgatctacattaagatcagaaagacccaacatattgatttccacatctccgtcataagctctgaaaattccctgtacggtcgggaatcttggctcgttcagttccttgatggcagtcaggagtaccggaagtttggtccgaatcttatagtctcctgtctccgtaaatcttgttacattcagagattccccgtcgcattcgatatgttttgcataggtgatctgtggaatgccaagaaattcagcaatttcaggtcccacttgtgcggtatccccgtcaatagcctgtcttccacataggatcaggtcataatctccgatcttttcaatggctgccgcaagaattgtggcagtagcccatgtgtcagatcctccgaatgcccggtcgctcaccagatatgcatggtctgctcccattgcaatcgcttcttttaatgcatctgtagcctgaggaggccccatacttacgacggaaactttggcgcctgtttcatctttcaggacaagggcagcctccaatgcattcttatcatccggattgataatgcttgggactccttcccggatcagtgtcccggtctcctggttgatccggacttcgttggtatccggaacctgctttacgcatacaatgatcttcatgctttccctcccattactttccgttagaatttaaaacggctcttgagatcacgaccttgtgaatctcagaagtaccttcgtagatttcagtgattttggcgtctctgtacatacgctccaaaggataatctttcatatagccatagccgccatgaatctgaagagcaaggttcgtaacaaatcttgcattttcagaagcatttaattttgcgatggcagcttcttttgtgtgaggctgaccagtgctttttaaataagcagcatagtagatcatccattttgcacactcggtttttgtagccatatctgcaatataccactgaagaccctggagagctttgatcggttttccgaactgaaccctctcgttcatatacttgacactctcatcaagagcgccttcagcgatccccagtgcctgtgcggcaacaccgattctggcaccgtccagagcattcatagccatcttgaatccggcgccttctttgcctacaagattttcttttggaacacggcactggtcaaagattaattctgcagtctctgaaccgtggattcccattttgttctcgatcttaccgacagtgaatcccggtgttcctttttctactaaaatacaagataatcctttgactcctttagatggatcggtcaaagcgaaaataagaagatactttgcctgacctccgccggaaataaagcattttgtaccatttaaaacatattctccggtctcctcatcaaggacagccgttgtccttaccgcagcggcgtcagagccggcattgggttctgtcagcgcaaaagctgcaagatgtccgctggatgtcacttccggtaaatattttttcttttgttcctcactgccgaactttaaaagtacagaagcaaagatggtgtgaatagacagaatacctgccgtggctgcacatttttttgcaagttctgtgacagtaatcaccttatcaatgtcattgcctccgcttccgccgtattcttccggagtcccgattccagtaagaccgagttttgccatctgctcaaaggtatctctcggaaagattcctgtctgatctacctcttcggctctgggacctaccactttttcagcaaattcacggactgtttttttcagcatttcctgtccgtctgtcagtttaaaatccatttttacctcctgctatcctaattacattacgccttcggcttttagtgattccagttcctcatctgtgagaccaaacacttctttgttatgctgtcccaacagaggagcaggagtgtctacactgcctggagtttccgtcaatttgatcggacaaccctggaaatacatttctccgatggtcggatgatccatgtgaaccatcatctctctcgcctggaaatgcggatggtcaatggcttcctgcatatctaatacaggaccgcaaggaataccggctttatcaaacagatcttcgatctctttttttcctttggcagcggcccactcgcttattacctgctgcagaccatctttatagtttttgcatctaagatcatttgtctcataacgcggatcatcgagaaggtcttcccgtccgatggtttcgcagaaagttttgaacagacggtcgttgccgacaccgatcgcaatatatccgtctttggcttcatagatatcgaaaggagcgatagaagggtcgatatttccctgacgctgagggatcacaccatccatcgtcgtcgtaacaatgccgttttccaaaagactgaagatcgtgtctgccatagcaacatctacctgttgtccctgtccagtgcgttctctgttaaatagtgccatcaggacacctacacacagatagattccagtcacattgtcagcgatagaaggccctactttggtaggaggagagtccgggaatcccgtcatgtttaccattcctcccatagactgggcaacaatatcgtaacaaggacggttggacagcggtccgtattgtccgaagccggaaccagaagcataaatgatgctcggattgatcttctttaatgtttcataatccacttttaatttcttagacacaccgactcggaagttttcaacaaccacatcggcatcctttactaagtcataaaagatttctctcgctttctcatttttaagattcagggtaaccccttttttatttcggtttaagaacgcataaaatccgctctcgccgcttttttcgtcgatcggtccccagcttctgcactggtctccctgaaccggctcgaatttaatgacatctgcaccattgtccgccagcagggtcgtacagaatggtccattatatgcatgggtcagatccagaaccttaacgccttctaatgctttcatgtgaacctcctcttatctaagcttttactttgtgttccggtatttcgtatacaaaaaatgcttctgttgaaatttccggatcctctaacatatcaatagaactttcaaattccggctcctcaggaatctgagccactttgaaagaacggcactgaatgtagactttatttccttcagtttttgtgactcttgcgataaattccatataatccccggcaaagacagggttatataaacgaattttttctacgaggcagcatcttccgacattgccgcacacttttgccattaagcggtctgcagtatctcccatatatgtaatggaacgtgcgccgtttactacaccaccaccgtaaaattcatctctgcttgacatcctgtatctcattgttactgtctgttcactcatatcaaaacctccttgatttgtctgtacctatcctaatatgtaatattaatcgattgctttccatggatctttgaccgttccgtccggctgtactcctcgctgaagttcttttttaactacgaggataacgtttccttctgtgatcagcttaggttcatcaaaatagtacatatctccatcctcagcgccttcgattccgagtctttttgcaggagtagccactttaaaagtctggatcaggcaggttcttgatgtgttgcctactttgaccatagttgccttaaagtccagctggtctcccacgtaagcatcttccatgaatttcacatcgttataaccgaggcagagggattcgtccccatcatttaaaatcatcagttctgtctctacatcgccgatgaaatcaaactgtctgccaaccgggatgacaccttccggattattggcatctgctgtagtcattttgtagcttaaaaatgcttctgttctcataatttcttacctcctgtggctgtttgatttttgatcttagctttactttaatgcatccggcaaatgcacagtcaatggctgttttggagatggtttgagattttttaagagaaaagaaaccaactgtcctgcggggggagggttgaatttaataataaatatcagaaatcttttaaacggtgagatgatttcgcttatatggttccggtttgcgtgtagtttgacattcaggagatataaaaatggggaagagttttatttgaagaaaatgattagatataggaaaaatcaacttggaaatgctataatgacaatagatgtaaaagagatacacaaagtttgagagagggggaaagaaaatgaaaaagtatattatcagtattggcttgcttcttattttttttctgtacggagaaacagtggatgaaccttcaaatttttataaaaaggtccagcccgatctaaacatgcggacagaacaatataagacggatgttacattaaaaacagacgggagttatttgataactgaaagaattaaggtgaattttttgaaacccaggcatggcatctatcggaatataccagttcgtggaaggcagtcctataaagataaagagaataaggagcataaatttttatattatgcggatgtaaaattaaatttggatgatgttaatacaagtgcgtcatatgataataaagatggaaactttatattaaagctgggtgatgaagaggcaaaagtaaacagtggaaattatcaattcagctatcagctgacaccgtatcatcaggaaaaagaatatcattatgtatattacaatgtatttcctggacagtggaaagattctattccgaaaggaagtcggtttacgatacattttccgaagaagataagcctctcacaggttaagttttatactggagaacagggaaatactgtggatgccagcagtgtggctgatatcaggatagattccgcaggacgcaggatcacggggacactgacgaaagatctgccggtcggatggggcattacctgtttcggagatttagataaggggtattttacttcagtaaaacgtccaacactgggaagagaaatcttgacggcggcaggactgatttcccttgtcctcattatattatttttgaagtttaagaagaaagatgaaattattccatcaattcaataccagcctccggaagatattgacagtgcggcaataggctgtatcattgacggaagtgcagataccaaagatgtaatatcgctgctgctttactgggcggatcagggttatgtatttctgcagcacaaaaagaatgaaatgattgcctataaactaaaagatcttccagcatatgcacctgagtaccagacatatttgtttgaaaaaatgtttacgcaggaggaaccatttctttcgacaatggatgttccggagcgaatgacaggagcagtagaagcaacaaaagaaaaactcaagaattattatcaggatatgatttatacagaagggtccagaacggcaagatttatcagcagtattttaacgatgataccaatagcactatttatgatattgagtacacagtatgggattttaagtgaaaaggaacagcactatgaaatgtatatgtttgctgcagtatgcattggctttttcattatattgtatgctgcagatcactggtattctttgtctctggaagacagaaagagagatctgatcattgccggcacattatgcattggtgcgttggggatatacagtattttttatatggaaatggtaaaaaagcaaaagatttttaattttgcaggcgtaatggttttggtatgcataatgacagccgccggcatcctgctgactgcatgtatgaaaaaaagaacaaagcagtgtgttgagtggatgggatatctggtcggccttagagatttcatagaaaatgcggaactggatcgaatgaaagttttgggtgaacagtatccaaatctattctatcatatattcccctatgcttatgtattcggtctgtcagaaatctacgcagataagctggagaagctgaatgtggaaatgccggtttggtttggaaacgccgaaggagattatatattcagagcacagtatatgaaagactttcaccaggactttaatacatcaatcagcatagacagttcttcaggttccggaggcggaagcgattcttcaggaggcttctcaggaggcggtttcggaggcggcggaggcggaagctggtgagggtgaagtttatattgacttttctcctttgcattcgtataataatcttacttaattcagaaagaggtagcaaacaattatggacgatgctgatgacagtgattcggcaaacaatttaattcagatcatttacaggcgtagtctgctgtttcacacaatggcggactgcgccttttcgtatgtgcatattcatatgagaaggtgacggcagatatttgcagatgaaccggaagtaaagacgagaatataaaggagtatattgaaatgaataaaataggtgcgcagttattattacagatcattctgatttttttgaacgcttttttcgctatgacagaaatcgcagtcatttccctgaatggagcaaaacttaaaaagatgtatgagaacggggacaggaaggcgggaaagcttttaaagcttgtggaagaaccggcaggttttctttctaccatccagatcgggatcacgctggctggatttttgggcagtgcttttgcagcagataatttttccgggtatcttgtaacctggatttatgatgatataggttttacagccatatctgcggcagctctggatacgatagcagttatattgattacactgatcttatcttattttactttgatcttcggagaacttgttccaaaacggatcgccatgcaaaagccttttgctgttgcaaaaatatcctgcggcgttgtctctggggcggccctcattatgaagcccgtggtatggtttttgtcggcatctaccaacattgtgctgaaaatcctgcatatgaaaacagaagcagaagaacagactgtgacagaggaagaaattcgtctgatgatggaactgggtgaggaaaaaggaaccatcgacagtgaagaaaaggaatggatcgaaaacgtttttgaattcggtgacaccacggcaggggaccatatgacacacagttctgaagtgacggcagtttctcttgcacagtccgcggaagagatcctgaacatcatccgggaaaccggactgtccagattcccggtttatgcaaaagggttcaatgatatccggggaatcctaaatgccagagactttctgatgaatctgaatgagaacagggaaaagactttagaagaaatgctgagacctgcttattttgttccggagaccataccttcctctgtgctgttccaggatatgcagaagaaaaaaattcatcttgcagttgtgatagatgagtacggggaggtcagtggtattgtcacgatggaggatcttctggaggaaattgtgggaaacatctatgatgaatttgatccgtccgaacctcccaagatcagcaaggctgccgagaatttgtggaaatgctcaggggcagtgaagctgaatacgattgcggaagagctgggtgtggagattccggaccatccggactatgatactcttggaggactggttttcagccggcttcattccattccaaaggacggcacaacctttgagttggagatttgtggcctgcatatccatgtgaagaagatgatgggaagaaaaatagtggaggcagagattcagaagagaaaaaacccccgggaaatgctataataattcatagatgagagggggtataatatgaagaactttagcctgaagaatttgattccattgctgctgctgctggctttttttcttataacaggcgggtatttcgaccgttttacggaagaacttgattccggggtaaaaaaagatttatatatgaagacggaaacttatgacgtagatgtcacagtggatggggaaggctattatctggtgacggagcagatcaaagtaaagtttttagaagacaggcatggcatctaccggtacattcccaataaaggatttgtggcatatcaaaaggatggagatataaaaaaatttccatatctcgcgagagtagagcttgaacttccaaacagcgatataaaggaatctaagcagaacggtgcgaaagtatttcgttttggttacagtgatgaaacagtccgcaaaggtgattatgaatttacttaccggctgacacctgagcggcagggccagcctttcccgtatatctattataatatctatccctcaaagtggaagaatgatattccaaagggaagccgttttacgatgcgcttaccggaaggcacggatttagaaaaactcgaattttactatggagcctatggatcggcagaaagtgcatccgacatcatagatctgagaaagaatcaaaaagagaatacaataaccggaattcttaaggaagatcttcctatgggcagtggtatcacttgtttctcaggacaggtacagaagggatttgcgggggtaaaagggaaacccggaatctcattatttctttgggttccgcctgtgattttgctggcagtactggctgtcctgtatctgtgttttggaagggatgaaaaaatcattccttctatagaatttgaacctccgcagaatatggacagtgcagctgtggggtatgttattgacgggatcgcggaggacaaagatattctctctttgatactgtactgggccgataagggtaatctgtggatagaggaggaagaggaatacctgatgacgctgcataagctgaaggaactgcccaaagaggcaccaagctatcagcacaccgtattccggcggttgtttgagaatggagactctgtctatttaaacggcctgaaaaatgactttggtctgacaatgagcagcgcaaaaacgcagctgatacaagagtttgacggggaaagcaaagcgggaatctataccaaaccatcgtggagactgcagaggctggcgtttctatgtacgctgctgtcagttatctgggttacagtcctcacagggcattattcttacatgactgcagtcggcgttgtgattcaggcgctgctgtgtaccggcatggggctgggaatgtatttttgctgcaggggaatcgacggctggtattctttttccagggcaaagaggactctgatgactgcaggcggtgcaagtcttttttacttatcagaaatactgtactttgttttttatacatataaggcatccgggaacgaaattttcgattatacaatggaaataggaatcgtcctggctgcagcggcagttatgatgccgctgacctgtttcatgaaaaaaagaactccaaaatgtatccgatggatggggcagctgtcaggactgcgctcctttatcgagactgccgagctggatcgtatgagagtgctggcaaaaaatcggcctgagattttttatcatattatgccttatgcttatgtattcggtctttatgataagtttgcagagaaactggaggtgctggaaattcctgctccgggctggtatcatgccggatacgaaataaaaagctggaatgcaggagttatgctgaattgtatggcagggaatcttacatttgccgcagtctctctgagtcagccgtcatctgtgaacgcttccggaggatcatcgggcggcggaaacaaaggaggtttctcaggcggaggcttcggaggaggcggaggaggcagctggtgagacccagtgcgccaaaaggagtgtttttccaaaagaacttgtagaatccttaaacagcgtggtaatataaagggaaatacaggaggatgaaaaagtgggaaacaaaaaagttcttagaatggtgcagattgctctgttcatagccatcatttttattatgacatttacaccgcttggatatttacggcttgggttattggaaatatcgcttcttacgatcccggtaggggtgggagccatgatcttttcaccggcagccggggcagttcttgggctgtcattcggactcattagttttgcaagattttttgggatgaatccgtttggggcagtcctggtggggatcaatcctttttatgcctttttggtggcagtgcctacaaggacgcttatgggatttctgacaggggtgatcttcagggcactgagcaagggaggaagcgcgaaaactgcccgttattatatcggaggtttctgtgcaccattcttaaacaccgtatttttcatgggagttatggtgctgtgctactggaacacggaatattttcagaacctcaattctaccatgggcaatctgaatccactgatgtttatctgtgcatttgtgggtgtcaatgcagtggtcgagattctggcgggttctgttgtcggaggtacagttgcgaagattcttcataaggtactgaaaaatacgtaggcagcacacagagtgaaaagaaagaaccgcaatacaaaaaacaggttccgctggttggacggaacctgtttttatatttaatgaaaagagaggattaaaatatatgaaaaactatatttaaagtatatcagaatccctgccagatacaatgtatagaaaataaacaattataaacgaagtataaacaaatcttagaaaaaccttacgagcgatatgttttattttcatatatttgtacatatgttataatataaatattcaaatgttatataatacagcaaggaggttttatgaaaagctctgatataataaaagagattcgttcccttttaaatatgagtcaaagtgaattggctgataaaataggcgtgagctttgcaacagttaatcgctgggaaaaaggacgatgcgaaccatcacagattgcagtgaatgcaattaaaaatttatgtgcggaaagtaatattgatttttctcagtttgaagggaaccgtgttattacgaccgatgaaatcgtgacgctttatcatggctcaaagtctggaattcgcggagcgattgccccggtgagccgtgaccgatgtgattttggaaaaggattttatatgggtacagaccgcacacagccactcactttgatttgtaattatcccgatgccaaaatatatactttgagtgttgatttatcagaccttaaaattcttgatatagaagtaggattagattgggcatttttaatagcatataatcgtggtaagatggagtcagtaaaacattcaaaaatatatgatcgatttgctggcttgaacagagagtatgacatgataattggctacattgcaaatgacagaatgtttgtagtactcgatcgtttttttaatggggagattactgatcttgcattaatcaacagtctttctgcgctaaagcttggtaaacagtatgtggctttaacagaaaaggcctgccggaatataaaaattcttggggaacaaaaactttctgaaagtgatcgggaaaaactaaaacgggaaagcgaaacaaaacgatcaaaagggattgcattggcagaggaaatctgccgaaaataccgccgggaaggccggttttttgatgagattctaaaggcaggtgagtaacatggcaagtctttctcttgaaaaacgtcagctttgtgacatacaaggcaggctgtttcagcttgcgctaaagaatggatatgattgtccgagctttataaaagcatttatgaacagccgaacggctgcagctcttgacgatacctatgaccgcttacagtgggccggtgaggaatatattctcgatgagcttaatgatgaggtacatggcttaaagacggctggtacgatttacacaaatgaagtgatgtactggacggggtatacctatcgctattggcactattacacaggcgagaacagtcgtgaaatctatagaactgctgatgaaaaaataatgaaggaatgctggctcggatttcacacgttagatgttgaaatggccattgatgatttgaaggagattcatcggcagacatatcagaacaagggtgtttaaaacagctggtcttggtcagttgttttaaaacacccttgtcctatgtttaatgaaaagagaggattaaaaatatatatatgaaaaactattataccaggcagggaatacatccggtagttatgtaccctgcacgattaaggcatatttaaagtatatcagaatacatccttgattcaatgtatagaagataaacatttctaaatgaagtataaataaaccttagagaaatcttatgaaacgaaagaaaaaaagacttacctctgccgctcccgcagctttattacgatataaagtaaaggtattaaaaaatttaaaaaaaccattgacagggaagaacgcagatgatattataatctcaacaagaaaacaataacaattactgttattaaaaatcttggatagaaaataaagaaaacaaaacatagaatcaaaagcaaaggagatcattattatgaagaaatgggtttgtacagtatgcggttacgttcacgagggagatacagcaccggagaaatgtccgacatgcggagttccggcagagaagttcaaagagcagacaggagacagagagtgggctgctgagcatgtagtcggagtggcacagggagccagcgaagacatcatggcagatttaagagcaaactttgaaggagaatgctccgaagtaggtatgtatcttgcgatgagccgtgtggcacacagagaaggatatccggagatcggattatactgggagaaagctgcactggaagaagcagagcatgcatcaaaatttgctgaactgctcggagaagtcgtgacagacagcacaaagaaaaaccttgagatgagagtagaagcagaaaacggggcgacagcaggtaagtttgatcttgcaaagagagcgaaggcagcaaacttagacgcaatccatgacactgtacatgagatggcaagggatgaagcccgccatgggaaagcttttgaaggattactgaagagatacttcggataaaccttaagtatttcccacagccagaccaaaggctgtaaaaaaagaaattcatacacttttcttgatcatacacctctatttaatacgagaagccgggagcgatcccggcttctttttgcacataaatgaatcccactgcataacttatgaatatgctgcgttgtttgcgctgaaagatgcgcgctacacgccgggatgtttcccggttatttaagatgggtatactaaagataaaaatcagaaacagctaagtaaaacgaatttcgaggtgaagattgagatgttaaatgaagaaaagattagttcaagaatggtagaaatggcaaaccgctcagacggaaggaaagggctttactgtatttgcagccatatgggctgggcaggcttcctttcagacggcggcaaagttgaaattccattggaagggataccgggacatatcaaaacagacagcattaggattgatcggagagtacccggggaatggctgcaaaactaccgggtttcacctgaaaaaatttgcttttccaactatattccaggggaggtcatgctgaaaacagacgaccggatgggaagagaaaagaatattgtactgcatgtgaagatccgcggataaaaccgatgaaaatgtcacagtttcctgcaaggatatttagtggtatactggtatcaaacataaaaggaggaaaagagaatgatagcattaatagttataatagcaataattgcagtactggccatctggctgatcagttcgtataacggatttattactctgagaaataagacagaggaagcatactctgcgatggatgtgtccctgaaaaaacggtacgatttaatcccgaattatgtggaaaccgttaaagggtatgcaaaacatgaggccgggacactggaaaaggtagtgtcagccagaaatatggccatgggagcttctgatccggaagaaaggcttgccaatgaaaacgtacttaccggggcgctgcgttctttatttgcggtcgcggaagcctatccggatctgaaagcaaatcagaacttcatacagctccaggatcagcttcagaggatcgaagaagagatcgcaggttccagaagatactacaacggagttgtcaacaaatacaataccaaagcagaaatgttccctggaaatattgtagcaggcatttttaaattcacaagaaaaccattgtatgagatcagcgatgaggctgagcgtgagaatgtaaaggtatcgttctagtgctctgacgcagggaggtcattatgaaaaaattatgggcatccggcttcattgcggttaccctgtttctcttatgtatagggataggggctgccgcagaaagcatatcaggcccttctccgtctcaggtgcagcaagatccctatatgtatacgaagcagtttcagacaaaagttgtggtgggaaacgacggttcctatgatattacagaaaagataaatgtgagattcctggaagaccgtcatgggatttaccgctatattccgagcaaagggaccatagcttcttatgataaaaaaggggagattcagaaaacaccgttctatgcttctgtaaaaatgctccgtgccaatgaaactgtggatgaaagcagtgaaaacggcagcactgtctttcggtttggagacgaagacaagacagtgagagaagggatttataagtttgaataccttctcaccccgaagtttcagcagaaaagttatgataacatctactataacatttttccgacacagtggcagaaccagattccggcagggagcaggtttaccatccaatttccgaaaaagtttgatatggaccggctgaaattctactgcggggaatatggttcaacaaaagatgccggggatattttaacacttgtcaaagatgaagaaaatcttaccgtaacaggcacattaaaacaaagtcttccgctgggaagcggacttacctgttttgccgggatgaaagagggatatttcagcaagagccagcaaatttccggtattccacggatgatcctgataccatcggtcattatattcggaattgtactctgcttgtttcttttgttcggacgggatgagaagatcattccgtcaatccagtaccagccgccggaagggcttgacagtgccggggtaggctatattattgacggaaaagtacatgagaaagaactgctttccctgatcatttactgggcagaccggggatatcttaagattgaagaaaaggaagggaagctcatcttccataaaatatcagaccttgagaagacagcaccaggttaccagaggatcatgtttgataacttattcgacggcaaggatcaggtaaagattgaagatctgaaatataaatatgcagacacacttaaagtggcaaaaagcaagctgatccgatattttggaagagaaaagcagtttagtatttatacatcaggttcaaaagcagcaagggaaatctcaatggggctctctgcgttgccgttaggactgtttatggtggtcaccagtgtctactcttataccgggataacaaggatcatcgttcaggctgtcttgtggatgctgttactcggtggaatgatcttattcacggttgcggtggacagctggtacgccagaagcagggacagcaggaggctgtgggtattctggggtcttgctttgagctttctgtcagcggcagcttacacaggaagttatattgttagagtcataaatggagagatttttagctacatctgggttctggccgcagtgcttgttatgaccggcggaatgattcttatgacaggattcatgaaaaaaaggacccatcagtgtattgagtggatggggtatctggccggactccgtgattttattgagacagcggagctggacagaatgaaggtgctggcagaggaccagcctcagatgttttatcacatcatgccgtatgcctacgtattcggtctctccgatgtgtttgcggagaaattaaaagacctcgggctgtctgcgcctgactggtatgaaacagaccggcagtttacattttttgattattatatctttaaccggtgtttaatgggaagtatggaccaagtgacgagtacactttccgtgcccgaaccgccgaaaacatcgtctggcagcggcagcttcggaggaggctcctttggcggagggggattctcaggaggcggtttcggcggcggaggcggcggaagctggtagaagataatgaaaggtggaggaacaagtgtataaaaacgtatcaaagttattgatctatggtgatatggaaccggattctattttgatgcagctcagtgatatattccgctgcatggatgaagaaagccagccgaaggaagttttgacgaccagagtattcagacagatcaaacgcatccttcaggtggcgacagactatggattcgatgagaatctctggcataactacctgacatttctgctgattaccaatgagaatccattcagcatcacctgtgaaaaggtaggggccagggacggaagcgtgaattattttgcggaaaatgattttcgggcatttaaggagctgtttgactacgacttttcaaagattgaagaatacctgggagtggactgtttcagccgtctttcagactataaagcgatcggaaagccagagcttatgtataataaaaatgtcagcgagaaggttcgggcattgagccggaaactggagcagacacgggatgagcatgagtttttccaggtggtcacagacttctataaagcttacggcgtgggaatgttcggactcaataaggctttcagaattgaggaaaaaaccggaggcggcatcactttccgagcgatcaacaatatggataaggtcgcgctttcagatctggtaggatatgagatccagaagaagaagctgattgacaacacggaagcctttgtccatgggcggaaagccaacaatgtcctgctgttcggagacagcggtaccggcaaatctaccagtatcaaggccattgtcaaccagtactatgatcagggcctgcggatgatcgagatctacaagcaccagtttaaggatttgtccaacgtgatcgcacagatcaaaaaccggaattaccgatttattatttatatggatgatttgtcttttgaagagttcgaggtagagtataagtttttaaaggcagtcatcgaagggggcgttgagacaaagccggaaaatattctgatctatgccacatccaacaggaggcacttgatcaaggagacctggagtgaccgggacgacgtaaagaatgaaaatggtatgcacaaatccgatacgatggaagaaaagttatctctggtaaataggtttggtgtaacgatcaattactctaagccaacccagaaggagtactttaacattgtgatccagctggcaaggaaagaaggtattaccttatcagatgaagaactgcaaaaagaggccaacaaatgggaactgtcccatggaggtatatccggaaggacggcacagcagtttgtaaattatttgatggggatggaacagagagggaaataacggagaaacaaaaaaggaagtcatgcgctaattttgctgcatggcttcttttttgtatttatttttaaaaagatgatgctttttatatttttcaagtcgttaggattgacttgggaataaaaacatatgttgtttgcgttgtataaatggtagtatgcgaaaaaatgattcatattcttgtaaggtgaggtaaactgcaaacagtgattaacaaacaatgaatactaaggaagggatgatggatatgaaggtacaaaagagcagaaaatatattgccaaaaaattgggagttttagcgatggcggctgttataactggagggagtttttgtcagccggtatttgctgcaaagacaataacatcggcaaaaacagaaaatgcagtccagaaacataataaagtagcagcagatccaacacaaggggaattacctgacaaagacggtaagccaagcggggtgaaatgggcattagatactgcaacaggagaactttctatcacggggagtggtgtgccgtatctgggatccgttatggataatccggcggcatctccattttggaaatcacatcgtgaggaaatcaaaaaagtagttattgaaaaaactgtacgaccagtatctatggaaggttggttcagcagatgtagcgtgctagaaagtgtatcgaaattgccagatagtgttgtgaatgcgcaccgtttatttggagattgtataagattgaaaaaaactccggattttccggaaaatttagaagttgcatcctgcatgtatgacgggtgtaaaaatttaaccactgtttcggatttgcctgatcatttgaaagatgcaatggatatgtttagcggatgtgaaaaattagtcgatataccaaaactaccacaaagattagaaagtgggtatagaatgttcgcgggggctggtatagaaaatgtattagaatctgatcttccaagtggtttaaaagacggttcctatatgtttcaaggatgtaaaaaaatagaaaaggtctatggattgccggatagtctagaaaagggatactatatgttctacggatgctcaaacttagattatgtgaagaagttgcctaaaggcttgaaagacgcacaaggaatgtttggagcttgttataatttaaaaaaatttacaaaggaatttcagataccggataaggcggtgacaacagtgatgttttgggcaagagaaggagagctacatccgacttgggttcctgctgccaataagtctttggtaaactatcctaattggggatcggaaggaagaggaattatactttactgtacagtaagcttacgagattcagaaagaaagcttttaaaagaagtggatgtaagatatggtgatgaatttaaaaaagaacaattacctcaggccccaaagggatatcattggattttgccggatttgtcagagttaaaccaagttgaaaaggatttaacagtaaccttacaaaaagaaaaggaagagtatacagtaaagttccaggattggaacggaaaactgctgaatgagcagaaagtaggatttgaagaagcagcaaaagagccaaaagcaccagcaaggaccggatatacttttacaggctgggataagagttttgacaagattaccggagacaacgttgtcaaagcagagtataagaagaatgaatacacagtaaagttccaggactgggatggaaaactgctgaatgagcagaaagtagaatttgaagaagcagcaaaagagccaaaagcaccagcaaggaccggatatacttttacaggctgggataagagttttgacaagattaccggagacaacgttgtcaaagcagagtataagaagaatgaatacacagtaaagttccaggactgggatggaaaactgctgaatgagcagaaagtagaatttgaagaagcagcaaaagagccaaaagcaccagcaagggcaggatatacctttacaggctgggataagagtttcaataagattacaggagagataacggttactgctaaatatagcaggaatccagcaaaggctgattcaaccccacattataatgcacagagcaaaaagccgggtgtagagagtctaaatagaaaactgccgttaacaaaagctgtaaaatcagggcgccagatcaaagtcagatggaagaagaaaaaaggtgcaaaaggttatgtcatttactatagtactaagaaaaaagggaaatataaaaagattgctgtagtagggaacagatcgaatacaaaagtaatccttaaatccgggaaaaaatattattttaaagccagaccatatacgaaaatgaaaaatggaaaaatcaaatataaaaaatacatcaaagcaaagaaaaaagagttaaataaagtagtacaggtaacctacaaaaatgtttccggttacggaaaatatgaaatctggatgaaaataggaaagaaaaaatataagaaagttaagagtttttatcatggagggactttggtttatgtgaaacaaaaagcaaagactggaaagaaacatagctttttgttaaaagcgagtgtcacaaagagtggaaaaagtgccagagtaataaagtgaccccaatacagattagggaatagtctagaatcttttgcgtaccgtcggttcttttgttggcgatacttttacatagctgttgtatttgtggggagaaaagaatgaatttaagaacaacaaaattctggaaacgatttacagtgtgccttatagcagctatgctgctggcaggcaatctgtcagttgcaatcagagtacaggcgggagaaaagacagaagttcagctgcttgaaaagacttttaaaaataatgtagcagtacaaggagatctgttagaccaatctggaaaaccaagcggagttaaatgggattttgatgctgccagcggaaagcttacgatatcaggtaaaggcgtaccgtgtggtttcaagtcagaatttgatggagggccggttgctccctggtatacatataaggaaaatattaagaagattgaaatcaacagtggggttgaaccagaatccatggcatattggttctatggatgcaagaatcttgaagaatcgccggaattaccggacagcgtgaaaaacatggaatgtacattctatggatgtgagaaattagagaacgcaccggaatttcctgtccatttagagaacgcagacggcatgttcagattttgtactaaccttaagatcacacataaaattccagcaagtgcaaaaaaattatcggcactgtattataattgtgaaaacctggaacttccaaaagattttcaacttccaaaaggggtagaagatctgcaattaatgtttacgggctgttataagctcagacatcttccggatggatttcggattccggatcatgtcaaatacttagatggtatgttttggaactgtatagggctgaagtatgtaccggatttgcctggagatgctgcgagtgcagagtggatgtttgccggatgtgcactggagaatcttccggatgactttcagcttccaaaagggattaaaaatgtgaatggcctgttcattggaaatgatctgctgaaaaaactgccgaatacatttacaatcccggatggggtagaggatgctgctgaaatgttcagcggttgtgacagccttacgaaactgcccaaaggctttcatattccggcaagcgttaaaaaaacagacaatatgtttaaagttgcatccggctctcagaaaatgctcttaccgtacaagaatgagtctttgaaaaaatatgcaggatggggagcagacggaagaacagtgatacaatattgtacggtagaatttaaagatgtaaatggaatagagatcgaatctgtcgacgtaaattgtggagaatctattcaaactgttcaaatacccaaagcgccgaaaggatgtcactgggaaatccccgattctttaacaaccatatcaggggatatttccataatggcaaaaaaagaagagtacacagtaaaattccaggattgggatgggagacggatagatgagcaaaaagtaaaatatgaggaagcggcaaaggaaccaaaagcaccggtaaggccaggatatacatttacaggctgggataaaagtttcgataagatcacacgggatataaccgttactgccgtgtacaaaaagaatccggaaaagactgatccgattccacatgttccgggggtaaaaaggccaaagaaaaaactgccgttaacaaaagctgtaaaatccgggcgtctgatcaaagtcaggtggaagaagaaaaaaggtgcgaaaggttatgtcatctactatagtactaagaaaaaaggaaaatacaaaaagattgctgctgtaggcaaaggattgaatacaaaagtaatccttaaatccggaaaaaaatattattttaaagccagaccatataccaaaacaaaaaaaggaaaaaagaaatacaagaaatatatcaaagcaaggaaaaaagaattaaataaagcagtacaggtaacctacaaaaatgtttcaggttacgaaaaatatgaaatctggatgaaagtaggaaagaaaaaatataagaaagttaagagtttttatcatggaggaacgcttatatacacaaagcaaaaagcaaagacaggaaagaaatataaattcctgctaaaagcgagcgatataaaaaatgggagtaatgccagagtgataaaataatcccgatatatcttgtggatacttcatatgtgtaccgtcagttttttgctggcggtacgtttcatttcagggataaggattatatgaatacctggaattagcagaggtattatgatgtcctttccagcagagatatttagttttatactgaaatcaaatataaggaggattatgattatgccaaacgtagattatattattttagtgctgattgcactttcaggagtgtttatggtggttacaaataatctgttatttatcgggacagacaagtatacagaggaatctctaaagagatatgcaagaccggcagggattgcaacgatgtttctgggtgattcggctgggcgattctctatatgatgcggcttttctttaaggaaaagatcagcggatggattgttgtgagctttttagcattgactgttatagcaactattgcaaatattgtcattacaaaaaagacactggagaaaaaatagatgattacgattgatcatattacaaagaaatttggtcaggacaaggtggctgtaaaggacgccgtatggaccataccggatggggcgattacaggatttataggaccaaacggagcagggaagacgacaacatttaaaatggtcacgagtgtattgaaaccggatgcgggaaagatccttatcaacggtatggatattgtgaagcagcctgtgaaagccaaagagcagtttggatttgtatctgacacaccagataatttcctgcgtctgaaagggattgagtacctgaattttatgggggatatctatgaggttccggtcagggaaaggacccggttcatcaccacatatgcaaaccgcttcggtatcgaacaggttttaggtgataagattctcagctactcccatggaatgagacagaagaagatgatcatggtcgccctgatccacagtccgtcggtctggattcttgatgagcccatgaccggtctggatcctcaggcttcctttgaactgaagaaaatgatgagagaacacgcagacagtggaaaatcagtgttgttctccactcatgttttggaggttgcagagaaattgtgtgatcaggttgtgatgatctgtaagggtaagattcaattccagggaaccttggatcagttagaatcaaagtttccagaagacacggatctggaaacgattttcatggagatgacctggcaatgaaaaaaagattaaactggcgtctgtcctccttcggtgcggcctgggaagcgggacgacagacgaccgtaaaaaatcaacaaaccatataatttcaagtcccattctgcttttatgcctgcttccggtcatgtattatttgtaccggggaggcatgatcttggcggaacttttcggcaggggaaaaacgattggagcagttgtaaaatagagatgttgaagttattgaaaaagggagtctgatgattcaggcttcttttttagcaggggaatctaagaatgaaagaaaataaaattattattataggtgtattagcagtcatggcagaaagagtgacttattttgcacgtatctattttgtatttccggagtatctcaatgttttaaaatggatcttgttggggattatgattgtttgcattattttatactataatatttccaaatgagaagcgctgagtatgatatgtatgtcgtttgcgtcgaaagatatgcagaatacgaaaaaatttagaggaggggatcaaaagtagtattattcagatatcaaaagaaaagcataggagaaaggaaggaaagatcatatgaggagaaaaggagcagtcaaagcagcggcatggttgatgtctgcgtgtatgttgataggaagcctgccagccatcccgggaatgagccggaaggtttcagcggcagaaacaaaaatagagggatttgcgacaaaggaacagctgctgacagactacagtatggacggagcagcccgcaagaagattgggaaagtaacatttggacagaatgaagagggaactgcccagagttggtatattgccggaaaggatcctgctacagaagatgggttggtgttgtttgcggcatctccaatgaagaaaaagcaggcgtttcacaatcctgaaactgatcatccgtatgatgcagcctggggatgtgaatatggaagtgctccaagtcaggtaagtgcaaatcactatggaggaagtgacataagaaaagttttaaagaatatgtcgagcgacccagcctattttacagcagacgaacagaaggtaatgagagaaacagcggtcaagacagaggatcaaaagaatggaagcgtttatacgacaaaggataagatgtatttagcacatggagaaggcggaagtaagctgattagtgtcggaacaaacgaagaaaaggatgttaatgcggagttaaaaatcgacttggatcagtatcagaacggaagtagttggttttggctgcgttccccgaattcttcctatgattattcagcgctgatggcccaaccggctggtactgtgactacgtatgacaatggtgtaactggaaggtactgccttgtgcccgccttacagattaatctgacatcggttatctttgcatctgctgcaccagcagcaacatctgaggggagccaggaaacgaaaggaaaagatatgaccctgcgttatgatgcaggagaggatcttggatctgtggaaatcttaaatcataagacggcagaggtgaaaaagacagcagaagatcgatatctggtcgtgcaaaatgatcagggagtatggagaaagaaagcagaaaatgaaactaccgtttcagcaaaagaagttacaatagatggaaaagccctaaattcttttaaaggatgtaaggtttggttagaaaaaaccgatgcaactaggattacaaaagcaacaagaccggatcaaacaggagaaaagcttagtgagtacactgtcaccttcaaagattacgatggaaaagtactggaaactcagaaagtaaagtatgaggaaggagcgaaagcaccaacagcaccaacaagagccggatacacgtttacaggatgggataaggatttcagcaaggtaacaggagaattagaagtaacagcgcagtacaaaaagaatgaatataaagtcaccttcaaagactatgacgggaaagtactggaaacccagacggtgaagtatgaagaagcggcaaaaacaccaaagactccaacaagagctggatacacgtttacaggatgggataagacttttagtaagatcacagcaaatatcatcataacggctcagtacaaaaagaacccggaacctgcaaagagaccgacagaggttcatccgggcattaatctcacaaaaaaagagatcttgtcaggaaagaagttccgactgagtgtaagaaatcgaatcaaaggtgcaaaagtcagctataagacaagcaataaaaagattgcaacagtagataaaaacggaaatgtaaaaggactgaaagctggaagagcaacaattactacaacgataagacagggaggaaaaacctattacttaaagtctagcattacggttaaaggctatgtgaagctgatcaaagtaaaaaagacgattaaaaaaggaaagagttataaatttaaggcaaaggcctatggaatcaaagggaaactgaaatggtctgtctccaaaaagaagatcggaaagatctcaaagagtggaaagtttaaggcaaagaaaaaagggaagacttacgtgaccgtgaaatgtggaaagtataaagcaaaagtatgtgtgagggtgaaataaaaaaagagaattagttaaaaatcgggactctttaaagaggtcccgattttttaaatcgtgaaacctgtttgatttgctgtttacgctattttttggagagaatacgtaagaaacagcagcagataatgaaattaagtaaaatataaatattaccaataaaatagatagagagaaaggactatgaaagggaaatgtatgacattatgtactattatgaagcaagtacagtgggagaagcaattgcttttttgaaaaaaaatcctaaggccaggattgtaagcagagaaagtgatgtgtttataaagaaacgcaatggagagacaacaggacgtgttctgctcagtatcggcaggataccagaacttcaaagaatatctgtgaaggaaaatggggatctggagattggaacagccattaccttaagttccttactaagagaaacattgatctgtgacaaaatttcttatcttaaaaaagtagcaggccaaactggcaggcctaagtggaagaagacaggatcgattggaaatgctttttgtgctgggataattggtacagaagtcgtccgggcttgtggttcgttgggagtaaaactaaagattgcgggtgaacatggcaccagagttttaccagtaaaagatttttattctgtgtccgtaaaaccagtattaaagccaggagaactgctgacctatatcattgtgcctaaaaggcaaagtccttctttgtctgtcattaaatagaacaattaacagggtatcactcaaagaaaatgatgtggtaccctgttttttcacaatgttgctacactccagactttaaaagcttcttttgcatgcttagaataacttctgcctacaggaagaacgacctcgtttcgcaggaggcaggaggaagaagtaagttttacgactctgcttaaagctaccagataagacttgtgaatccggataaaattatgttcgcaaaaacgcttttccagattagaaagcgtttcgtatatttcaaattgttcctgtttataatggatataaactttatgattttgaacctccagataagaaatatcttttaggggaatgatgcagtttttactgcggtatgtaaaaatcaactgctcatccgcctcttgctcggcttttgttacagcccggacgatgatttcttcaaatttttcttttgatacagcatcttttatgatgtaatggtaagcaaaaacgtcaaaggcttcaagcatcttgtcagaaaggctggtaagaaagataatcttgctgtcaattccattctcccggagttgttttgcggtttggatgccgtcgatgccaggcatcataatatccagtaaaataatgtcggaagaagtcagatcttcagataaaaataaaagctgctctcccttgttgcaaacttctatggtgaaatccaaatcatattttgtcttaatatttcttaacatccacgtatagagtttgcagcaagtatcttcgtcgtcacaaagaattattctcatgttcagacacctccagattattagtgaacagcagaaatcgttacacagattttgcaactaaatggactgctgctcttttttctattatagtatattggcttcaagagaaaaagagtgaaatgacgtcaacgcaggaaattatagcgggaataacatattaaagacggctgttaagttatacaatcgacaggggcagctggattttgggtgtttgcgtcggtagaagtgtaaaatcaggagaaaggctcaaaagaacttgtgggagaagtataatataaacgttaaaatgataagcataaatgaagggaaggaaaaaataatgagaaaagaagcagtcaaagcagctgcatggctgatgtcagcatgtctcttaatggggagcctgccggccagtccggggaggacaagaaaggtttcagcggcagagcccgaaatagagggatttgccacaaaggaagagctgctgacagactatagccttagcggagcagcagacaagaaagttcaaaaagtaatgtttggacaaaatggaagaggagctgcccagagctggtatatcgcaggaaaagatcctgccgaagagaatggattggtgttgtttgcagcgacaccgctgaaggaacgacagtggttttacagtcccagagttactcatgcttatgaagcgaactggagatgtgagtacaaaaacaatccaagtcaggtaaacggcaatcactatggaggaagcgaaataagaagtgttttaaaagatatgtccagtgatccatcctatttttccggagcagaacaaagggttatgagagaaacagcgatcaggacagcggatcaagaaaacgggagcatttatacaacaaaagataagctgtatttagcgcagggagagctgggaagtaagcagattagtgttggaacaaatgaggaatcgaatgtaaataaggggctgaaaattagcttgaatcagtatcaggatggaagcggtgattggttttggctgcgttcaccgtgttcttggtatgatctttgtgtgttggcggctcggtccggcagtgctgtggattaccacagtatcagtataaacaatgcacatcatgttgcgcccgcgttgcagatgaatttgtcatctgtcatttttgcatcttctgcaccagcagcatcatttgaggggaaccagagaacgaaaggaagagctctgaccatgcgttatgacgctggaagaagccttgggtcagaaacaattctgaatcaggagaaagtagagattagaggagtcgcaggcaatcgttatctggtagtacagaacaagaatggtgcatggagaaaaaaagtggagagagaaaccacagtttcagcaaaagacgttatgatagatggagtaactctcaattcttttaaaaattgtaaagtttggttagaaaaaacggatgcagacaggatcacaagagcaacgaggccgaatcaaacggagactccatctgcaaaacagacctttgatttttatggcattgggacttcggcaggaaaagatgtacattttgcacagcttgagtatgcggggggagatcatgcaatactgcatgggctgaatgaatatggcagtcagattcatccatactttacgggaagatacgcttatatcaaggtaagaagcaaagaaggaaagctgttgttttttaaagaatataaagggactgactggacacaaaaacacgacacaaagatcccaatgccggaagatgcaagagtcagcatttatcacgcagaaccagatcgcttgcagacaaacagtgatgacagtttaaagaaaaatgcgtttaagaacacctatatttatgtggtgaaagatcacaaattagtgtctcaaaagcttgaaaagcagcagtttgaatttttaggtttaggggactgggaatttgcaaagatggacataatcggcggaagtgcatggattgatacaaactatacggactatggaccgcattgttacttccagaaccaggtatatgcttctatcataatcaaagatcaaaatggaaaagtgatcaagaaaaaagaatatatcggccaaaagaatgagccggtgggaagcgaagacattttacttgacgaaggttatactgtgaccatttaccacgcagaaccaaaccgtctgcggacaaacaatgaccagcagctaaaacagcatatgaaagaaaatacatttagctatatttataaaaaccagaaattagaagagattaaaaggtgaagtatgacattttccacatgatttccgttcggctcttagaatgcctcactccaatcatgtggaaaatggatgtaatgtctgttggagaagggcctctgtcaaaaaaggtgccacctgtgatagtgagatagctaagaatcgggatccttttaagggatcccgatttttaaatgaaatcatgttaagatttaagattgtcagtgatttttagaaactgatttacgattttaggatcaaactggcggccgctttgtttttttaattcagcgagggctgtttcctggcccattccttttcggtaacaccgggtgcttgtcatggcgtcataggtatcagcaacgctgatgatccgggcaatcaaaggaatctcatcgcctttaagaccgcttggataaccagatccgtcaaaacgttcatggtggtataaagtaccgtttgataacccgtccagcattttgatatcctttaagatgtcggcgccgattgccggatgttttttcattaactcatactctttgtctgtgagacggttttgtttttttaagacggcatccggaatgccgattttacctatatcgtggagaagcgcaacaaaataagcattttcagaatcctgttctgaccatccaagactttgggcaatctgtttcgtatagcctgcaacacgcctggaatgaccgttggtgtcaggatctttggcatcgattgtatgagctaaagcagccatagtctgaagatatgccgtctcaatctgccgggttttttcatcaagttttttctggagttcttttcgatatccggtcagttccagagttttttccacgcggcttagaagaacttctgttacaattggttttccaataaaatcatatgccccgatattcaggcactctgcctctgttttgtcttctgtgtcagaagtcagaaaaataacagggatatcagaccactttttttctttgtgaatctttagaaagaattcctttccgtccatctccggcatcatcagatcaagcaaaatcagatcaggggtctgatgctccatgattttcagtgctaaactgccagataaagcgggaaatacatgataatattttttgagcagtatcattatctggtttaaaactgttttactatcatctacgattaaaattttgtgcatttaaaattcctttcatcagtaaaatttattatttatatagaatagattaagaaaaaagaaaagtgagattatacttttcactgtggttggcaatgttaatggaatcattttatttcattataatacacttttccagataaagaaaacgtcgtttgcatcgaaaaataagttggatgcgaagattaaagcgggagggaggaggaaagtaatataatgtaaaagtcaacgaaatcgagtcaaagaaaggaaagaactgatgagaagaaaaagagcaatcaaagcagcagcattactgatgtctgccagtctcttaatagggagtctgccgacaatttcaggtctgggtatgggccggaaagtttcggcggcagaagaagagatgagtgggtttgccacaaaggaacaactgttggcggactatagccttagcggggccgccggtcaaaaggtccaaaaagtaaggtttggactgaatggaaagggagatgttcagagctggtatgttgccggaaaagatccggccacaaaggatggattggtgttgtttgcagcgacaccattgaaagaacagcagtttcagatttttccaaggccgaaagtgtatgaagcgaaatggggatgcgagtatgaaactgatccaagcatggtaaacggtaaccactatggaggaagtgagattcgagctgctttaaaagctatgtccagtgatccgtcatatttttccgcatcagagcagaagcttatgagagaaacagcggtcatgacaggagatcaaagaaatggaggtctttatacaacaaaagataaattgtatttagcacagggagaacccgattccggaacgattcaactcggaacaattaagaaatcggatgtgaaacatgggctgccgcttaaattaaaactgtataacactgaaaataatgataaatggttttggctgcgtacgccatacgctgtccaagggttatctgaaagtctgctgaccgctcgctctgctggtgtcagtgctgctgttgcggatactgaagggaccgcaattgtgcccgctctacagattgatctgtcatctgtcatctttgcatccacagcgtcctcagaaaagggacaggaaacgcaaaggaaagagttgactctgcgctatgatgcgggaaagagccttggctcggcaaccgtcttgaatcatgaaacggtaaaagtaaagggctcagcagaggatcgttatctggtagtgcagaataagtatggcacatggaggaagaaagcgacgaaagaaaccactgtcccagccgaatatgtcacgataaaaggagaagagctcacctcttttaaagactgtaaagtatggatagaaaaaaccagtgaagatcgactgacaagagcaacagaagcagaagaaaaggcagcggtaacgtttaaagactataacggaaaggtgctggaaactcaggaagtgaactatggtgaaaaagcgaatgcaccaaaaaccccaacaagagagggatacacttttacaggctgggataagaattttaacaagattacaggaaatgtgactataacagctcagtatcgaaagaatccggagccaacgcagccaaagcagccaacgattcgtccaggcatcaatcttacaaagaaagagattttgtcagggaaaagtcttaaattgagcgtaaagaatcgagataaaggtgctgttgtaagctataaaacaagcaacaaaaagatcgccgctgtgaatcagaatggaaccattaagggagttgctgcgggaagagcaacgattactacaatagtgagacaaggaggaaaaacttatacgttcaaaaccagcgtgactgtgaaaggctatctgaaactgacgaaagtgaagaaaaccataaaaaaaggaaagagttataaatttaaagcgaaagcttatgggattaaaggtaaatttcactggaccgtgtctaataagaagattggaagcatttcaaaaagtggtaagtttaaagcaaagaaaaaaggaaaagtttatgtaattgtgaaaaacggaaaatataaggcaaagttccgtgtacgagtaaaataaacagaaactactttgggaggatttgccgatgaaaaatgttttaattactgtcattttgatagtcagtgttgctataacggcagcaatgggaatcagaagctttctttatcaaagaaagcggcaaggagttgactattacacaaagataacgccgctctctgaacgtaaagaaaaaaatgattatttttataaagtcaaagcatttgataaaaacgggaatgccataaaattgaacttttatggcatggacggacatcctatcaagaaaggcgcatatctcaagattacatacggaatcgtatctgatggaagcaatgatgtgaaaagatgggaagaggtaaacaaaagttcaattcctgagaaggctctgggaaaaatagagaaagactagatgtacgatctgtctcttaaaataagagagtatgagatagagtgtgttagttcaataatatggactacacactctatttatattgacaattacagacagttatacatcaaaatagaacaccggtttaaatccccatattcaaaattatcataggcggttttgagccggtccaggagattttgcagttctcccggataagtgtatcggtccaattttgcaatagcatcggagacctcttgataatccatttcattgacggcaatacagagacttttgatgatatcttcgggataaccggaaagagattctttcgtttcgtctgccgccggtacggctttgatacaacaatccagttcttctaatataaggtctgtatagtccagcagttcctgatacttctgtgtgatggatttccagttgttttggtggccaaaatcctccattgttttcgccaagtccgaaaattctagggcgcctacggattttgaggcagatttaatggcatggacgtggatggtaaacaatttgatatcctggttttcatagattttatccaattcatttcggcgttcaaagagaccctgccggaaggttttcagcatctccaaataaaaatcagccgagtgatcaaaatattccagggatgcatcaacgtcgaaatgtttcaaagatgtaaaacaggctttgacttcttctgagataaaagcttcgtccagctttttttccacaatctttaagacggctttgtcctgtaaatactgaaggagggtgttgtgcagttctttgacattgatcggctttgcaaggaagtcagaaaatccctgttctgtgaaataggttttcgcatcggagaagacattggctgtcagggcaacgacaggaagatcttttctgatgccgtccatttttctcagcttctgtaccgtctcgattccgtccattccgggcatcatatggtccaggaaaatcagatcatagtcttttgcggaagccattgtgagtgtatcaaaaccattggacgccacatcaatatccatttcataaggttccatcaatcgttttgcaacggaagaattgacatcattgtcatctacgatcaatatgtgggcagaaggaaacgttgtatcctcgtaaacgtttgtctttttggacgcggtcttgaccggatggccgtttaagatatttgcagtctgcatcatcaggttgtacggatacagctgctgatagttatagtatttggattccgtagtatcactgtttttcataagaagcagcacatgatcctgcaaaaataaggaatcgatcatttcctggcaggatgggaaatccgcctgctgcatgatcagataagaattcttgtttgatctgtccagactgatggaggagacggacgaaatcaaagaaggatggatgctaagcttgcgcagttcgcgtatgacatattttgtcagttctttatccgattctggaagatagacataaacctcggcctgttccattttgtcagacggcggaatcataggagcggctaaacagatttcctgtggaatggtaacaataaatgtactgccttttccgtattcactttctaccgagatactgccgcccatcagttctgttagtttttttgagatagaaagacccagtccggttcccataatcgtttgattttttttaggatcgactctgctgaattgccggaacaagtgtttttgatcttcctctttgattcctgatccggtgtcggaaataaagaaggagagctctgttttggtcttcgacagattcttagcgcgaagcttcagttcgatattaccggaaactgtaaattttacagcatttgcaagcagattggtcaggatttctcggatccgcatctcatctccgatgagctgccttgggatggaggggtccaaatcagtgaaaaaatgcagactttttttgcttagacgagcggaaattatgctgcatatgtctgaacacatcgttgcaggagaatattttcctgtggtcagctgtatatttcccgtgtccagtttggagaaggacagcaggctgttgatgattcctaaaagtccgttgccaatttcatagatcgtggatatgtcctgctccacatccagagggagattttttcgcagcagcagttcacttaaattcaggatagcgttcatcggagttctgatctcatggctcatattggcgaaaaacgccatcttttcctggtggatctgccgttccttctctgcaagccttgccaaatgctcttcttccattttttcgctgtggatgtcctgtgtgcagaaaataatatttgttttgtcgtcttttaagtagctgtattccgctcttttccagcggtaagattcatgggtcctgatccggtatgtaaaactgtaggaggtatcaggtctttggttgagataaccggtaatgccggagagcgttgcattcatcaaaagttctttcgcctcttcatcataggccagctcctttgctgcatgaaacgtgagttcgtcaaaatctccttccagttttttttgggaaaaccagtctctgtcctgtacggcataaatttgatatttgccgttcccggtgttgatcagcccaagcgtctcatagctttggctaacgatcaaagtacacatttcatttaaaatctggatttctttttctttggcataatcggagtaaagttgtttttctacgttggccgtgtcatcagagaacacacaaatataggtttgtgtaagagcggaagaagagagaagagatgctgtcccgctcagccacgatttcttttctcctacataaatcggacgggtaaaaggaaagtggtctccgatatttttcagacgacttaatgcatcaatgaattcatcgtatgcatttcccggaagtttatcgatgaaagaatgaaaatcaaatgagtagtctgaagaagtttcatagcccaagattttgcagccaaaatcattgatatggagaagagtcagacgatcaccgtctctctgaaactgcatgactccggtgggaagattttcataagtcgattttaaaaaaaggaattcctgctgctgatccaacaaatcatctcctgtctgttttctttctattatattatatccaaatcaaaggggaaagagcagcggagcataaaattttgttgtttaggacgctgaaatggtcggatacgaatcatgtctaaaaaatgggtatagagaagataaaatagataaaaatatgcaaacagaaaggaaggcctatgaaaaagattatttttgctgcggtggctctgatttttattgctgctgcggtgataagtgtgaaggaaattttacatggaaaaaaggatacaggaatcagttactatgcaaaaatcatagcaggatcggagaagaagaaaaactcagagtgtttttaccatataaaaggatttgacgaaaatggtaacgacaggatgctgacagtatatgcagatcagggtcagccttatccaaaagggaaatatttgaaaatcacttgttctgcgaaagctgacggatcgaatgaaatgatgtggagtatggtgaaacagagcagcattccgaaagaggcaatattaaaaatacggagatgggaaaaacgaattagacagctggctgttaagaagagttctcaattagggaataacttaaatgtacagaggaacattgataaaacaaaaaaactgattgcattttcttttgacgatgggcctgccagggagaatacagaccgggtggtaaaagcattggcaaagaatcatgcaagagcaactttttttatgcttggacagaacgcttcctattatccgcggcttgtaaaagaagtaaaagattcagggaatgaggtggccggacactcctggaatcatccgcagctgaccaaattgggtgcagcaggggtatgccgccagatgcagaaaatgaattatgcgatttcaaaagtgaccggctcggatgtaggtctgctgcgcccgccttacggagccattgatcggatggtgaaagccaatattaacgcgccattgatcttgtggagcattgatacattagactggaagactttaaatacagatgccacagtaaatacgatccttaaacaagcgaaggacggagacatcgtattgatgcatgatattcataaaccctctgtggcagcggcagaaaaagtccttccactgctgaaagacagaggatttgaagtctgtacagtttcagagttattgaaggcaaagggaatcactgtggataaaggcgatgttgtcattagtgccaatcagatttataagtataaaaagaatcagagatagaaaaagtgttgtttgcgtcgtataaagtgcagtttgtgggttttaagaaaaaaataggatgtaacctgttataattaatttgtaattaatcatcagctgaggaaggacagctggaaacttttttcctcaaaaaaagataaactccttttgcagaagagccgtccggcagaccgggcggctcttttgagatttaaaaagcttgcgaatagattgcaaaaagcaagcaaaaaatatataataaaagtaatagaaaataaaggagatgatagatatggctaagacatcaaatatttttacccgtgtagatcctgaaataaaagagcaggcagagcaagtgcttgagcgtttgggcattccgatgtcaaatgcagttgggatgtttttaagacaagttgtgatgcagcggggactgccatttgaagtgaagctgcccaaagatatgccgcttgtatacgactcccttacgaaaaaacaatttgatgcggaaatagaaaagggcatggatgatataagaaagggaagggtatattcggcagaagatgtcgaagaggagatgaagcgggattacgggatatgagttgcaggattttttatacaaaaaaggcaaaacaggatttgagagatatatatgaatatatagcgtatgaactgcttgtgccggaaacagcatctgaacaaactcgtagaattatgaaagaaatcaagacacttgatgaaatgccgagacgttatcgtttatatgaggaagagccatggcatagtgaagaaatccgattttttccggtggataattaccttgtgttttatcaacctaatgagtcccaaaatacagtgagtattgttcgtattatgtacggtgggagagacatcaaaaatcatttggatagaacgacaatcgattaatatttttctgacgtggcagaaagagccgtccggcagaccgggcggctcttctggcagcttaaattatttcttataccgataaacatcattcgcacttaccacgacatctcccggatgcagagtaatatttctcgcctcaaggagctccgataccgtacatacttgaaagcctttcttttcaagtttcgggagtacctttttcacagcttccgccgtgggagcatggatgtcatgcatcaggatgatatctccgtctttggcctgctttaaaatggcatcagcagtcttgtctgcattcagtgttttccagtccaaagtatcaatgctccacaggatcagcggatctttcaccgtattttttacagttcggttaatggaaccataaggcggccttaaaagtcccacatcagatccggtcacagaagcaatggcttcgttcatctgcgacatctgttttttcacaccttttttaccgagttttgtgagcagcggatggttccaagagtggccggcgacttcattgcctgattcctcaactttttttacaaggtcaggataatattttgcattctggccaagcataaaaaaggtagccctcgcattgtttttatccagggcctttagtattttctccgtattttttctggaaggtccgtcatcgaatgaaaacgcgatgagttttttctcgggatcgactcgtttgggaagaaaggggaaatcgcccagtttaaactgtgtaatttcgcggacgatcttctggttcttttgaatctctccgctggcagccgaggattcctgaagagaacttgtctctttgctggtccggaacaggtaaatgccctgaaaagcgatgattgacagcattaagatcagcactgcggtttgtcctttgtttaatccttttttcatttgtgcctcctatccatacatagtatttccgttttccagcaatccttgacaaaagaacatggaaaggcagggtgaaattacaagctataatttattgtatgtggagagatctgattatattaagaaaaatctgttataatgaaacatatcatattttataaatttttgaatatcacttatttgacggagtataaaggatagagtttatggatattaaaagaatcggagaagccgggcagcttagatccatggatacggtgaatggatttgatgtgcgtccggggttttaccttcaaaacggtgcgactgctattgaaggcggcgtgagtttcaccgtacatacgaaaaacggaactgcctgtacattagttttatatgaaagaaaggcacaggaacctttcgctgaaataccgtttccggaaaattaccggatcggaaatgtatactcgatgatcgttttcggcctggatatccggaagatcgaatacaattacagagttgacgggccgaaggatttaaaaaagggacttttgtttgacaaggagcggtatcttttagatccctatgcaaaagccgtcaccggtcagagcaactggggcgagaaacctgagtacagcagggactgttatcgggcgagagtcgtctccaatgactttgactggggaagagccaggcgaaaacccacagatatgcgggaccttatcatctatgaacttcacaccagaggatttacaaaacaccatacatcagatgtaaaacatccgggaacctttgacgggatccgggaaaagattccttatctgaaggatctgggcatcaatgccgtggaactgatgccgatctttgaatttgacgagacgagggataccaggtatgtcaatggtaaaaaacttttggactactggggttataatccggtcagcttttttgcgccgaatacaagctacagctcggaaaaagaatttaacagagagggttcagagcttaaatacctgatccgggaacttcacgacaatgatattgaagtaatccttgatgtggtgttcaaccacacggcggagggaaatgagaacggtccgttcatatcttttaaaggatttgacaataatatatattatatgcttacgccggacggaaaatattataatttcagcggctgcggcaatacactgaactgcaatcacccggtcgttcagaacatgatcctggactgtttaaggtactgggtgacggattaccggatcgacggattccggtttgacctggcatcgattctcggaagaagtgaggacggttcaccattaagtaagcctccgcttttggaaaggcttgcatttgacccgatcctgggccgtgtgaaattaattgctgaggcatgggacgctgcgggtctttatcaggtgggcacgtttccgtcatggaaccggtggtctgagtggaacggcagataccgggacgatatgagaagattcctgaaaggagatccgggccttgtgaaagccgctgcccagaggatgagcggctccagggatatctatgacagggagagccggggcgatacggcttcagtgaattttatcacctgccatgacggattcacgatgtgggacctttattcctataatgaaaagcacaatctggataacggatggaacaatacggacggagacaacaataacaacagctggaactgcggtgaagaagggtacactgaccggcaggatgtcataaagctcaggaaaaagcttgtgagaaatgcttttgcggcgctgatgaccagccagggtgtcccgatgatgtatgcgggggacgaatttttgaatacccagtatggcaataacaatgcctactgtcaggataatgaaatttcgtggctgaattgggatctgcttttggaaaatcatgagaccactcagtttgtcaaagagatgatccgtttcagaaaaaaacacccggtgttaagatccagaggggaggatgcgctgtgcggactgccttccgtcagctttcacggagaagaaccgtggaagttaaaggaggatgaccaaaaccaccttctgggtgtcctgtttgccggaagagaaaaagatagtgacacagatgatattgtttatgttatgatgaatatgcattgggagccgcatactgtgaggcttcccgaacttccgctggattacttctgggagattttttcagatacggccggcgagccgaaaaatagccggctgcccggaggagagatccggatggaagagcggagtatgattatattagaagggaaccagatgggacggaagggcgatgtcatctgtctctaaagataaagtttaagtaaaggaagagaatgtaagatgtggattgcagatcagtggaacgattatgaagttttagatacttcttgtggtgaaaaattagaaagatggggagactattatttagtacggccggaccctcaggttttatggcagacaccaaagaagttaaagcagtggaagaagccaaacggacattatcacaggagcagcagaggcggcggacagtgggagttctttgatctccctaagacctgggatatcaggtacagagaacttacatttcatttgcagccattcagctttaaacatacaggagtttttccggagcaggcagtgaactgggattggttttcagataagatcaaaaaggccgggcggcctgtaaaggtgctgaacctgtttgcctacacagggggcgccacattagccgcagccgcagccggggcatccgtgactcacgtggatgcctccaaaggcatggtgaactgggcaaaagagaatgcccaggcctccggcctgaaagacaaaccgatccgctggctggtggacgactgtgtgaaatttgtagagagggagatccgccgggggaaccactacgatgggatcatcatggaccctccgtcctacggcaggggaccaaaaggagagatctggaagattgaggaaaagatttttccgcttgttcagctctgtacaaagattttgtcgaaaaaccccttattttttctgatcaattcttatacgaccggactccagccggctgtgctctcctatatgctgggaacggaagtcaaagcaaagttcggcgggaaagtgacggcagatgagatcgggcttccggtttcttcaaatggcctggttctgccatgcggagcctcaggcaggtgggaatcagtatagatatttcagaaatcttaatttttgctgaattttgttggaatacgtaaaaaacaattgaaatttttctgactttgtttataattaaaaagagcgtgtatacgaataattgacatttaacataatgataataatagaaaattcgaaaggggaattttgaaacatggcaggttcagatatcggaattgatttaggtacggccagcgtcctggtttacgcaaagggcaaaggagtcgttttaaaagagccatctgtagtggcatttgacagagatacaaacaagatcaaggcaatcggggaagaagcccgtctgatgctgggaagaacaccggggaatatcgttgcagtgcgtccgctgcgccagggtgtgatttctgactatacagtgacagaaaagatgttaagctactttatcaaccgcaccgtcggaaagtctattttcggacggaagccgcgcatcagcgtgtgtgtgccgagcggtgccacggaagtagagaaaaaggcagttgaggatgcgacctaccaggcaggtgcaagggaagtatccattattgaagaacctgttgcggcagccatcggcgccggaatcgatatcgcaaagccatgcggaaatatgatcgtggacatcggaggaggaacagccgacatcgctgttatttctcttggaggagtcgttgtcagcacttccatcaaggttgccggagatgattttgatgaggcaatcgtgcgctacatgcgcaaaaaacataacttactgatcggtgagcgtactgctgaggacattaagatcaacatcggcactgtctacaaacgtccggaaaatgcgacgatggatgtccgcggaagaaaccttgtgacaggactcccaaagaccgtgactgttacatctgaagagacagaagaagctttaagagagcctgcttaccagatcgtagacgctgttcacaacgtactggagagaactccgcctgagcttgcggccgatatctcagaccgcgggatcgttctgactggaggaggatctctgatccagggtctggaagaactgatcgaatctaagacaggaatcaacacgatgacagcagaggaccctctgacagcagttgccatcggaactggaaaatacattgaatttttatccggagaagacaaaaagggcgagaaataatcacttagttttttcagcgcttttttaagccggcagaggacaaccagggtattttatcctggttgttttgttacgccgggcgtttgtgtaaaggaggggagaagcatgggacggatttccggatatgttgaccatgtccgttttcggaatgaggacaacggatatacggtgctgagtcttgatatggacggcgatgaggagactgtagtcggggtattccaatttctgcacgaaggcgagtatatggaactggaaggggaatatgtggaacatccggttcatggcccacaatttcagatgacttcctatgaagttacgatgccggatgacattcagagcatggaacggtatctgggctccggggcaatcaaaggggttggcccggcgatcgccaagagaatcgtcaaaaagtttaagatggacacgttccgcattatcgaggaggaaccggagaggcttgcggaggtaaagggagtcaccgaaaagagagcacgcagcatcgcggtggagttttccgagaagcaggaaatgcgccaggccatgatgtttctgtccggctatgggattaccactaatctggcggtgaagatttttaaggagtacggcgataagctgtacggggtgatccagaacaatccatatcagatggcggatgatatagaaggcgtaggatttaagattgctgatgaaatcgccaggcaggttggtatcggcagcagttcggattaccggatcatatcgggcattttttatactctgatgcagggtcttgcatcagggcatatttatctgcccaaagaaatccttttaagaaatacttcaaggatgcttgaggtggaagaggagatgatcgagcctcatcttctggacatgatgattgagaaaaagattattataaaagaagaggaggaccagacaagaatttatggggcggcccagtattatctggaacttaacacggccaggatgctgtgcgatctcaatatgacttacgatgtgtctgtttccgaggtgaggactatgatcgcaaagattgaagacggtcttcagattacctttgcggagaaacagaaagaagccatagaagccgtcgccgaaaatggagtcgtgattctgaccggaggcccgggaacgggtaagacgacgaccatcaacggaatgatccgctactttgagtctgaaactctggatatcagactcgtggcccccacggggagggcggcaaaacggatgacagaggctaccggatatgaggcgaccacgatccaccgtctgttggaattgaatggggattccagcagcggggacagcatgaagtttgaacggaatgccgcgaatcctattgaaacggatgtgatcatcgtggatgagatgtctatggtggatatttttctgatgaattcccttttaagcgctgcggttccgggtacaaggtttgtgtttgtgggggatgccaaccagcttccttccgtcggcccgggaaatgtgctgaaggatatgattgcttccggatcttttaaggtggtggaactgaatcagattttccggcaggatgaagccagccacattgtaagcaatgcccacaggatcaatgaggggaagtctattgagctcgataataagagcagggactttttctttcttgagagagagaggctcggagatattttaggtgttctggtatacctggtgagagataagctgccggcttatgtaaatgccaagccgtatgacattcaggtgctgacccctatgcgcaagggggaactgggtgtcgataagctcaacgaagttctccaggaatacctgaatcctccggcggaggaaaagcaggagaaacaggcggtttcctgtctgttccgtgaaggcgacaaggtcatgcagatcaagaacaattaccagatggagtgggaagtaaagaatgagaagggatttaccgtggaagagggcaaaggcgtcttcaacggcgatatcggacggatcacaaggatcaatgactacacggagaaagtcaccgtagtctttgacgacatcagagtggcggaatactcttattccatgctggatgagctggaactggcctatgcggtgacgatccataagtcacagggaagtgagtatccggcagtggtcatgccgctgcttacgggaccgagagttttgtttaacagaaatcttctctacaccggagtgacccgggcgaagcagtgtattacgatggtgggccggaagtcaacggtacagcagatgattcagaatgtaaatgaacagaagagatactcgacgctttgtcagaggatcaatgaacaggaagaactgatgccttagggggatcggttcttttttttgtttcatcggaaagttctgcaataaaaatgtgattttatcacatcaaaatcggtataaaaatgtgattgtatttttttggacttctgtatataataaaaatgtgatgaaaaacacttaaattaaaataaaaatgtgggaagtgagtctatggaaagatttattttaaagaagctactggactggaagaattcttcctaccgtaaaccactgattatgaagggtgtgcgtcaggtaggtaagacctggattctaaaagagttcggcagatgctattatgaaaataccgcttattttaactttgatgagaacgaggaatataaacagttctttgaaacaacaaaggacgtcaatcggatcttgcagaatctgatgctggccagtggtcagaagattgtaccggaaaagactctcatcatctttgacgaagtacaggactgtcccaaggttatcaattctatgaagtatttctgcgagaatgcaccgcagtatcatattgcctgcgccggttctctgctgggcattgccttggcaaagccttcttctttccctgtgggcaaggtcaacttcatgcagattgaccctatgatttttacagagttcctgctggctaatggtgatgagaacttggtaaagtacttgaaaacggtgaacacaattgagccgatccccgatgctttctttaaccctctgtatgaaaaactcaagatgtattatgtaaccggaggtatgccggaatctattaagatgtggacagaggcacgagatgtcgctgctatgcaggaagccttgtccgggatcattggcgcctacgagcgtgattttgcgaagcatcctaatatcagcgagttcccgaagatttctatgatctggaagtccataccgtcccagctggcaagggagaacaaaaagttcatctacaaggttgtcaaagagggagcaagagcgcgtgaatatgaggatgctttgcagtggctggcagatgcccgtctggtgcataaaatctaccgcagttccgctcctggtctgcctgtagctgcctatgatgacctttcggcttttaagatttatctggtggatgtaggtctgctccgccgtctggcacagctggcacctacagcttttggggaaggcaaccgtctattcacggagtttaagggtgcgctgacagagaactttgtactacaaaccttggttacgcagtttgaagtggttcctcgttactggacacaaaggaatcctccctatgaggtagatttcctaatccagcgtgagaatgacattttccctgtcgaggtcaaatccgaggcaaataccgccagcaagagtctaaagaaattcaaggaactgttcccagacaaagtcaaactccgtatccgtttctctctcgataatttgaaactggatgatgatgtgctgaatattcctctgttcatggcagatcagactgatcaactgatcggattggcattagaacagatctagaaataaacacaaaagtattgcattgtataaaacagcatccttgcaaaggctgctgtttttgtgtttttatggattttgagttgattctttagcgggagagtgttattatttttacataaatatagaaataagatattaagataataacagaggtgagtatatggagaagccgatttatcgagaaattttattacagtatattaataaacaagaaccagaacagcctatccttacagaaagaattgcaaagtatgctgcggtgtgccttggagtggatgaagataaggtgaagaaagctgtaaatgtaaatatggcccggcttgaaaaagcagacttactaataagagtaacaaaaggggtttattgcaggaaaataaaaaccccttttggttattataggccaaataaagaaactgtattttgtaatcagcttttgcgggatgataccggtgcaatcggatatgaaacgggcttatctgcgctaaataagctcggtcttgtttctcagatgccaaaccgcaggagtattgcaacaaatcttcataacaaaagagttccgaaggagtttcaggtagatgtgcgcaagccggtaactacgattactgagtcaaactataagtatcttcaatttttagatgccgtgcgggggttagcgcatgcgccagtggatgtattgaaacctgaattagttttgagggggacagcaaaagattttgatttgaataccgatatattaatcctttttgcgcgaaagtattataatcagaaaactttgctgaaaacgattgatattttgctggagggtgtgtatgaaactgcataaggataaatataagttttttagcactatttccgtcacgctttgaaatgcgttcctccaatagtgctaaaaaactatcgttagatagtcccaaatggaccgccgcagagactttgctgaatgttagaaaatcttacatctctgaggtagcaagtcgtaaaactagtcaaaatatcatgacatacaaaaaaataccctggcagttaaacacagacttcttttctgtgcctaactatcagggtatatcttatttctgttactgtttatccgaagcacacatctgtggcaacctgagtctttcgatttcaataaaactcaggcattctaagagccgaacggaaatcatttgactacgtcaaatcgcatctggtacgcaaagttgtcaagcccctcaaggagtgaggggcttgacaactttgttcccgaaaaaggggtgttatattgcagttaaaggaaccaacaacatttaaggagcagcagattattctgtaatatcggtaagggtgtatttatagctgtggaattacatttaaattaggttaaaaaattacaaaaaatcctgccaatagccgtttcagctgttggcaggattttttaatgtgtcaatttgttgtataatgaaatggatatataaggaagactgcaaaagatatagtggaggtagagaacaatggggattttcgaagttttattgtcatctgctgtgatcgtagcgttgattgaatacatttctaaaaataagtcaaataaccttcagtacatcaccagtgccagaagtgagtggagaaaagccatgaaacagacagcctgcaggctgcatcaggcagacagaggaaatatcggagaagcgtttgcaaaattaaaggtcaacttaaacggatatggattctttccgtcgtttgaccaatatcctgctgataagcagcttgattttttcagagatgaacacatatggaagcaaatcgcatatatcgaagaaaacatgtactgctgggaagaagaaacattcacgcgggagaaaaataaggtcaataaatatattacaagcctgctgaagtttgactgggagaggacgaagcaggaagtgaagtctaaaagtttaattttgctgtgcacagttttgtatctctgtgtacatatcccggtactgcatctctttccggggaataaaagtctgattgggcagataagtgaacagataatcccgattacctgtattgttctggcactgatatcagtatgtcttccctacttggtcaatgaggctaagatactgcagtttggaaagtggtacaaatatttgacgtttaacattagtggttggatcataggaatttttttagaagcaggtgggctttggagattatcagcctgctcggatcactcggaatactggacttactatgtcacaggtgcagctgctttcatcataacaataggtatcatgttttatatttttggacataaaattgtttatttagactatgatcgggcagtaagaagaattataggctgtgattctgttatctgctaccattgcgggactggtattttagcagattttaagggttttgttgtgaatgacttttttgcgcagttaaatctggacttttcagagagagagctgccggaacagatggatgacatgatagagtttatctgcagtccggagaatcacattctcaaagatcaggagcaactgctgagatttggcagtcggataaggttcattttcaagagtgatattaaaaaatttgtaaaagaaaaaccaaagaggtgcaaacttatttttaagtatacctcaggatcagaagaacgttatgcggttggatataataaaaatacgaagaaggaactcagagaatggatttacgaagacagcgtaaatagaaataattagttctacaaaacagcatccttacaaggggtgctgtttttatgccgaaaaaagtctgtcaatccttggtgagaataaaacaatcgaaaaacaagaaagaaacaatcaaaaatatgttgacatatgaaagaaacagtcataatataaagataacaatcaaaataaaaaagtcaggaggtaaaagatgagagtcggatgtgtgacagagatcaagaaaaaggagtaccgcgtagggctgacaccggacaacgcaaaaagctatgtgtctgaaggccatgaagttcgtgttcagaaaggtgcaggcagaggatcgggatttgcagaccaggagtatgaagccgccggggcagtaattgtggaagaagcaagggcagtgtgggactgggctgagatgatcataaaagtgaaagaaccgctcaaagaggaatatcagttttttcataaagggctgatcttgtatacctatctgcacattgcggctgatgaaccgctgatgaatgctttactggatgcagaggtaaaaggggttgcctatgaaactttgatggaagatgacagaagtctgccgctgctgacgcctatgagccaaattgcgggacggctcagtgttcaggagggagcaaagtacttagaaaaaccatttgggggagagggaattctccttggaggagtgccgggaacacagagggcaaaagttgtgattctgggtgcgggaaccgttggttccaatgcatgcaagattgctgtgggcatgggagcctacacaacgatcatggacatcgacctgatgcggcttaattatctggatgatattttcgggagccggattcagactctgatgagtacagacggcgcggtgagagatgccttagccggagcagatcttgtcataggttctgtcctgattccagggaaagccgcacctaagatcataaaaaaagagtatttgaagcggatgaagccgggttctctaatcgttgatgtggcagtggatcagggagggtgctgtgaaaccacaaagatgacgtatcataatgatcctgtttatgaggtggacggggtagtgcactattgtgtgggaaacatgccgggagcagtgccgcggacctcaacgattgctctcaccaatgctaccatcggctatggcaggaaaatcgcagaacatggactggaggaagcgtgcagaaaatatccgtcactttattcagcggtcaatacatatgaggggaaaattacatgcagggctgtggccgaaagttttggatgcagttatgtgaagccagaccgtcttatggaatgagagaggcggaaatatcggcgggaaactcacaggaggatagtatgaataaaacgaattcttccaatgaaacaaaggtattggaatatataaaaacgaacggagaaatgacaaccggggaaggcatcaaacttcttggagtatctgagtcgactataagaagaatttttatcaaacttcagaaggaaggtgaagcagaccgaatttttgggggtattaaggcggtctcagaagaagggaggtaccggtataaggagattgccgtgcagaatgtggcagaaaaaaaggaaataggaacagcagcatcgaagctggtgaaggacggagaatttttatatctcgacagcggtacgacaacactggaaatgtgcagggcgcttgccagaaggctgaaacgcaaagaagtaaaaaatgtgacggcgataaccaattccgtaaagaatgtagacattttggcgtcgtattgtgatgtgattcttgtgggcggaaagtattccaaagacagaaaggatgtatccggaaatttaagtgagtcatttctgacccagttccgactggataaaagttttctgggaacagatggatttacatttgccgaaggatttatgtcaaccagtgttaatgtctcgctgctgagcagacgagcttcttcccaggccggggaaacctacgtattgatggattcctccaagataggccggcattcctttggaatcagctgtaagctggaaaatgtcaacggcatcgttatcgattccaaaatagaggattccgaccggattcaatttgaggaaaaatcagtgaaagttattacaaatgacaatattgaatgaaataatcaatattatgaatgaatcaatcaaaaaagattgactgtaagaacagaccgtgctaaaattttattaacaaaaatgaggaaggaggatgaggaatgatacggatcgtcccggaacatatcgacagcgattgtattggtattttgatctgcagccatggcagtattggccgcagcatgatcgaagcggtacagatgatctacggtgactgcccgaatattgcctgcataggactggaaccttctgacgacattgacgactgggggaaagagctgggagctttgacagaaatatttccgaaaggaaccattgtattcctagacttatttggagggacaccgtgtaatcagtacttgatgaacgaggcaggagaagcactcgcacagagggacggacaggcatgtgcggttgcaggagtgaacctctctatgatactggaagcgattggacagcgggagtatacagaactgaaggagatttcagaaatcctggacaaagcaggaaaggatgcagttgttaacgtattgcaaaagatgaaaaagtaagagaggagatgtatagtatgcatttatggcaggcaattatactcggtggattttactggtttagtttcctgggagtgttcgatcattccctcaatctgttattctatcagccactgacatcagctctgctggtagggcttgtaatgggagacatccccactgctatgatcgtgggtgctacgatccagcctatgttcctgggacagactcaggccggatgggtcatcaccaatgacaatgcggcggcaggtatcattacggcatccgttgtcatagcttcaggaatggatatcaaatcagctatggcagttgcagttgcagtgggtatcgttatgagccagctgaccaatatccgtatgacagtaggttccttctggaatgccctgactgataaatttatcagcaaaagacagtatgataaactgtggctgtccaccgtcatttacccatcgttatttaaagttattttgtattggcttcctatgacactcgttttgtattttggggcgagcaacatcggatttttcgtcaacgggcttccgggctggctgcagaatgggctgaatgcgctggcttctttaatgccgatcgtaggactctgtatcgtggcttcctctattggaaaaaagggctatatgccgttctttatcgcaggctttttatttgcggcgtattcgggagtcagcggaatcggcatagcgatcgtgtctgtgatccttgcgtggtttgacttccgctgccagaacaagggagaacatctgtcactgaatttaagaagcaccactgtagaagacgcggcactgagcaggagagatttaaattgggcgtctatccgtatgctgtccttctattccaatggaaacagttacgagaggtatcaggcaaatggtattgtagcgactatgatgccgtgcttgaggaaactatataagggtgatgatgatggccttcaggaagcaatggtcaggacatcggaattatttaatgcggaagatatgacatccgcacttcccgtaggtatcctcttatctatggaagaacagaaagccaaaggggcgccgattcccggagagattatttcggatacgaaagctgcactgtttcctccgatggcagcagtcggtgacacactaaactgggcgacgatcgttccaacaactttggcgctgatgtgtccatatgccctgacaggggcgtggtggccggcattggtcgttgtcttggtgggagccgtactctgtaattcccaggcatttttcttaatgcatctgggttacaacttgggaaataaggcaatcaaagatctggtgcagagcgggctgatcaacaaggtaatgtccttctttaccgtcatgggtatgtttgtaatcggcggaatgatcagttccctggtaagtgtatcctgtccgttgacgatcgccacaggaaaattctcctttgcggttcagaaagaactgtttgacgtgctgatgccgaatctcctgacctttattgcgactatgattatcttctttacgatcaaacggaaaaatatgagtgtcattaaagtcatcttcggaaccatgattgtgggaattatcctgggagctttgggaatcatagcgtgacattttctgcatgatttccattcggctcttagaatgcctcactccaatcatgcagaaaatggacataaggtctgccggaggaggttgtcattgaaacaattatattgatttttcttaggtgaaaagtatgaaagaatggaaaggtggtttttatatggggaaacttgctttggttagaattgataaccgtctgatccacggtcaggtggccagcgggtggattgggaagtgtaatgcgggaaagattgtggtgatcgatacagctacggcggaaaatgagatgatgagagatattctttcgctggcagtgccgccgggcattgaattttcggtttatacccaagaagagggaattgcagcttataagaatgaccggttcggaacggaaagtgttatgctgatttttaaaagtattcagactgcttatgactgctataaggcgggtattgattttgcagaactccagatcggagggacgggagtccggaaagatgcgaaagtactggaagggcctatcacggtgacagagaatgaaatcaaaatgctggatgaactgaaagcggatggggttgagatttatttgcagcagacggtccagagcaaaagtacgaaatggtcttaggatctgacggagaaggcggttggagggaagggttcttccctcagccgtttgcaatatgcagcttaattttatagtccttaaactgttctatttggttttccggaatgtttggatctgtgatgatggccgtcgcctcatccagttcggcataatttacataagaaggatgatcgattttggaggaatccaggagtacgtaggattcctgtgacagggtcagagctgtccttgataatctggacgtattaatattatcactggagaatccatgttcaaaggtcatgccgtctgctccgagaaaagctttggaaaaatggaactgggaaaggaaactgacacccagggtgccggccatgctctttctctcatcgaacagcataccgcctacgaggatgacattgcagtaagggtttaggatttccagattgatgagagagttcgtgacgatatttaagctgtttgaaagagtgccgttctggaagcgtgtcacaagggactgagccatataagcagtcgtcgtaccacagtcaatataaataaaatcagaatcctgaattaagccggcagcataactcccgatcatctctttttcttttttcatctttcgcttaataatatcgtagtgatagtagttgtccggtttggccaggataatacctccgtatgtccgcacgactttcttctgttcttccagcctggtgaaaattcggcggatggttgattcggaaagatgaaataattcaatggcgtctcgggtcagtaatttttcatgggaacccagatattccaggatatttgactctatttgctttttccgctcttttgacatgggaaacctccttgacggcttaaaatttcattatatccagtatagcatgaccgaaaataaatggcaatatcagccaaaatagtgaaagaaactgttcaaatcacgctggagcattttggctcagaaaggaaggaagcgttatgacagagaaagaacagaagtttatagacaggatcaggctggccgtacagctggcaaatgaagatgaggagggaaagaagctggctgaccggctgctggacggaaaaatcattgtcaggataaccgacggaatcacaatgaatattctgatcaaagatcatcaactgcagtttgtggattcttcggaccatccgagggctgtctatgaatatggtaacattgattccgccttaaaacttttagataaaaaactgagtacttattcggcgacagtccataaacagctgaaactgatgggtctgtctacattaaatgatgcatttgataaaattttgaatctggcatacgaacatgcaaacggattgaggtagaagggggttctgagtatgaaagcatacagctatgacaaaagttttgagttatatgaccgggctaatgaggttgtgccctgcggactgtacggacacttgggtgtcggcagggcaaggctgaatcccatgggatgttaccctctgttttcagagcgggcagagggaacttatatctgggatgtggacgggaaccgttttattgactatgcatgtgcttacggaccgaatgccctgggatatcaggatccggatgtggatgctgcggcgatgagacagagggaaaaaggaaactgtaccacggttgtctccccggttatgatcgagtgtgcagaaaaactggtggagacgattaactgtgcggactgggcttttttcgcaaagaacgggggagatgtgacgaccctggctgtcatgacggcccgccatgccaccggacgcaaaaagattattatgatggaacacggatatcacggcgtgtatcagtggtgtcagaaagcagggacaccaggggtgctggatgaagagatctgcaataatctatatgtaccttttaatgactttgaggctatcaaaaagatggtggacgatcatccgggagagatcgcaggaatcctttctatgccttatgatcatatttcacattatgacaatgtactgccggacgaggactattggccgaaagtaagaaaactctgtgatgagaaaggaatcgtgctgatcattgacgatgtgcgggcaggattccgcatggaccttgcagggtccgatcattattttggaatcaaagcggatctgctgacactgggaaaagccattgccaacggctggaacatggcggcactggtcggacgaaaagagatgagagaggcagtggaagacatgaactatacgggaagctactggctgtccgcagttccgctcgccgcctctgttgcagcaatcacgaagatgaaggagatcaacgctgtcgggatcatgcagaagacaggagaaaagctgacgaggggccttaagcagaccgcggacgcaaatggagtaaaattaagtactaccgggcttccgtctctgtttaagatcattttgaaggaccccgacgagtccctgatcccacatcaggtttgggttggagagatggtgagaaggggtgtctatatctctcattttcataatatgtttaccaatacggttatgacggacgaggatttgcagtatacttttgacgtggcggatgaagcatttaaaattgttacaaaaaaatatcctgagatattaatataaagacatctgtgattgaacatacgaatcaatgatgaaaaaaaccggtacttgctcaccggtttttttgtttgtataaatggaagtattttctaaacagagaagtttccagacttggcgagtgaaaaagtcagaagaattaaacaaaaaaagcacgaaaaaaggttaaaaaattaacatagttaccagtggctgtatacaatcacttgatttatttgtataaaatactgtacaattatatctgtcatttttttaacgaatttttagaacaaatgtaaaagtttatgtttcaaaaaagtctacttcgacatttgttcaacgaaattgcattgataaagatttaagattttgatagagttattgcatgataattaatacaatttatggcatcatgggatgggcattcatacaaacaggagaaaacatatgaaaaagatagtggatgattggagattgatttacaaatgctacagcttatattatgaagatgatatgaagcagcaggatatcagcgattaccttgggatttccagagcaacggtttcaagaatgcttcagaaaggcaaggaaagcggtatcgtaagagtcgaagtcatcaatccggtacagttttcgtatggcaagctggaaaaagcactggaacgaaaatatggtttaaaggaagttgtcgtagtagagagcagcccgctggacacaaagacagattccatatccaggctgtatgagaaggcggcactgtttctttcacagtattttaaggacggggattacataggggtttccatgggattcaccctgcacaacgtagcccgcaccaaccgtgcattttctaaggagaatcactatatgttcgtcccgatcctcggcggagtcagccagggaactgtttcaaaagtagatgtgcaggccaatcagatcgcaaaggaatttgcaaagaaatttggcgggacttacatccagtttctttcaccggcggttttttctgaacggaaggtcatggaatactttttaaaagaaaagtctgtgaactatatttttgaagattttaagaagctggacaccatcgtcatgggagtgggaattcctcaaagcggaggctccaccctgatccaggcgggttacttgaccaaggaggagatggaccagtatgtcgagcagggagttgcaggggacattgcccttcagttctttgacaaagaaggaaatgcggaaccgtttcagcagtttaacgagagagttgcgggaatgacattcccgatgattaaaaagatcagaaaccgtattgccattgcaggcggcgccaaccgggcggaagccgtgaagggagccatccgcggagggtatgtcaatatgctgatcacaaataacgagtgcgctgaaaagctgttatgagaaaggggtacatttaaagatgcagggaatttcggtatttttattagttatctttgtattgtttgttgtgcaggctgtagggggatactttcaggttaaggattaccgcagagcggtgaggagagttcatcagcttggaaacgtcgggatcggccagaagaagggaagatttctttcgggaaatattgtgatgatcgcgtgtgacagcagcggtatcatcaccggaggggaaatcatggagggactgagtttccttaccaagtttaaaccgatcaccaagattcttgacaaggagatggtgggaacgagtatttatgaacacctggatgtattccggggaatggataagaaaaaaagaaaatattacaaaggatatatccgggcgctggaagctttggatatgaggcttcaggggacgaccctttagcattgctttggaatatatatatagactgacaagactgcaaaaagaagactgactgaacttgttttgagggcccaaaagcatgttttagattggtttttcttttttgggaattttgtctgtaaatattttatatatataggataaattgatatatttcaattaagaaggaggagaaaatatggaaatcatatctaacgctgccaatggatttataaagttattccaggagggcggtaccacatttatgggatgggttaccggaatcatcccactggttgtctgcctgatgacagccgttaactcagtgatcaagctgatcggagaagagagggtggaacgcttcgcacagaagctgaccagatttgcagtacttcgctatacactgcttccgatcatcgcggtgctgttcttaggaaacccgatgtgctataccttcggacgtttcgtagacgagaaatacaaacctgcttattatgactcctgtgtaagttttgtacatcctgttaccggacttttcccacatgcaaaccccggcgaactgtttgtatacaccggtatctcagccggtatcacgaagcttggcctgtccatcggaggacttgccgtgagatactttatcgtcggtgtgatcgttattctgatccgtggactgctgacagagcagatctacttaagaatgacaggaaaaacaaacaaataatctgtgggaggaggaaagagtatgtataagacaattacgatcaaagccggagacggcggttggggaggacccctgacaatcactgcaacagaaaaatgccacaagatcttaagtgtaaccggcggaggaatccacccggtagctcagaagatcgcagatatgactggcggagaagcgttagacggatttaagacaacagcgccggacgaggaagtgctggtcgccgtagtggactgcgggggaaccgcaagatgcggcgtttacccgaagaaagggatctttaccgtcaatctgatgccagtagggcaggcaggaccgctcgcacagtttatcactccggagatttacgtgtccgcagtgacagaaaaatgtatcgtggaatctgactataaaggtgtaacggaaacagccaaaccggcagccgcagaggacggaccaaaatccaaagaccaggcgaaagaagagattgcagctgcaaacagcggcaaaaaagaaggaatcatcgttaagatcggaaaaggcgttggaaacgttgtcagcaagttcttccaggccggccgtgagaccatcgagatgatcatcaaaaacgtgctgccgttcatggcatttacgagtacccttttgggtatcatcagtgccagcggattaggaaatatcatcgcaaagacgatctctccattatgtagtaccttgccgggaatgcttggtatctcctttgtgtgtgccctgccgttcttgtctccgatccttggacctggagccgttatcgcacaggtagtcggaactcttttgggagcacagtttgcccttggaaacatcccgccgcagtatgcactgccagcactgtttgctatcgatgcacaggttggtgccgacttcgtaccggtaggattaagccttggagaatcagagccagagaccatcgaaatgggtgttccggccgtattattctcaagaatcgtaaccggacctttagccgtattgatcgcattcgccttcagtatcggaatgtactaaaaacggaggtaaaaagaaacatatgaaataccagtcaaccatcacaggtctgggaccggatgctctggcgttcctggccgatgaagatatgaactttattatcatttttaacgaagatgcaccgcctgaactggcagaactttctgtccttcatacgaaggctgaattaagggctgtgccggaagtcggagacactatgacgatttgcggcaaagagtttaagatcagcgccgtgggcagtgaagctcctcacactttggcagagttaggacactgtactctgagttttaaagggggcagtgaggcggaacgcccgggatgcatcatgctggaaggaaataaacttacagaggcagaccttcaggccggcggaacaattgaaatctgttaattaaaaaaggagatagttgttatgttaaatatggacaaaaaactgattaagagacaagaagacggacagatcattaaaaccggtatcgtaggagccggccagatggggcgcggaatggtaacccagatggtattgatgaatggcatgatgccggctatcgtatctgatatcaaagttgaaaatgcagtcaatgcattcaaatatgcgggtgtaaaagaagacgacatagcgattgcaaaaactctcgcagatgccaacgcagcaatggaagcaggaaaatatgttgcctgtgaagatgcaaacttcgtatctcaggcaaacctggtagagtgtgccatcgacgcaaccggtgtgccggatgtaggagcaaaagtcgctactgacgccatgaagaacaaaaagcatgtggttatgctgaacgttgagactgatgtcgtaatcgggccatacttaaagaaactggcagcaaaagaaggtgtcatctatacaggatccgcaggagatgagcccggagctgttatggaactttacagctttgcaaaagctatgggaatgaacgtcgaagtcatgggtaaaggaaagaacaacaaactggactatgactgcaacccggatactgtattagaagaagcaaccagaagagtcatgagtccaaagatgctctgcgcattcaaagacggaacaaagacgatggtagagatgacagcaatgtctaactacacaggattagtaccggatgtgatcggaggacacggaccacagacttcaccgggaaccgaaggaatcaaagaattaaatgatatcctgaagcttaagaaagacggcggaatcttaaacaaacatggtgttgtagagtatgtaaacggagttgctcctggagtattcgtaaccgtatccacaccgaacgaagagatcgcataccagatggcataccacagcatgggacctggaccgctttggaccttataccgtccataccacttatgtaacttggagacaccgcttacggtagcaaaagcagtcatcgacggagaagtgacctgtgtaccgatcgacggattagtatctgagtgtattacaagagcgaagatcgacctgaaagcaggccagaccatcgacggaatcggaggattcacaacacacggatctatcgcggaagcaaaagaatctgatgcgaagggatatgtaccgttcggacttgtaacaaacaaggcagtgatgaagagagacgtgaagaagggtgaactcttgacatacgatgatgtggaattagataagtctactctgatctaccagctgagaaaagagcaggacgctatgtacggaagaaacgttttataatcagtacaaaattaaaaaggagccttgctgtaaggctccttttgtgcttaaaccagcgccaaagccgtctcttcgtctgtaaaaaacgaattgacgagctttaaattcaaggctacatcaatgatctgtactttgtggagtccgtcggctacaccgatggaaacccgtgcatttttggcagccttaaagatatctgctttgattagatgttttgttgcctcagtttctacagtttcaccttctctggtgaggaactgaagggccacatcaccgatggcgtgtgcagctttcagttccgcgatctcctgatcattcaaaatgttgtagcaggtgagaatcgttgattcaaaacttcccagacccatgaggagaatatccgcatgttcacccaaattaaggatctgccgtgtgtgttcattggagatcagggtttcatattcttctttggaagaacaaaaggcaggaatgtgaagcatttttgcggttccgccgatggtatttgccagctggagagtgttataggtgggaagcgcctcgaaggattcaccgaagcttccggccagagggacagtctgtacatccggaaagctgatgggatgcagttctttaataaaacgggacacggcatttccccagcccacaccaacaatgtcctttggcttcagctgtgagatgaagtaatccgcggcagcctgtgctacataatctctgttttgatcttttgtgctgatgacgcctgcataacttaagccgtatttttcttttagtgcttcctcaagctggctgtttccggttacaggggaattgatttctatctttacgatgccaaggtcttctgccctggacaaaagcttggagacccagggccttgagatacttaatttttttgcaatttcctgctgggacagcttgttcttataatacagagttgcaaccagaacgatcttgtccagcatattatctggattttctttcttcttcatagggtaacctctcgatcatgaatttattaaggcacatatgtaactatatgataagaggattataagccatttattcagggttttcaaggtttttgtgaaaaaatatattttagtattgacgaacatatgtaaagtgattataatgaagttaacaaaagcaattaataagcacatatgtaactggagaggatgagacaaaacaaaagatgaagaatacaccacggaacgttaaatgaaaggagccaaactgtatgaatggtatttcggtttttttattagtgattttcgtattgtttgttgttcaggctgtcgggggatattttcaggtgaaggattaccgcagagcggtaaggagggtacataagcttgggaatgtcggaatcggccagaagaaagggaggctgctttcaggaaacattgtgatgatcgcctgtgaccagaacggagtgatcaccggcggggagatcatggaaggattaagcttcctgacaaagttcaaaccaatctctgagtttctgggaaaggaactcgtcggaacgagtatttatgagtaccttgacgaagtcagaaactttgagaaaaagagacggaaatattacaaaggatatatcagagctttagaagctttggatatgagatttcagggaaataccttgtaatctgaaacaagatatatagaacggctgaagagagtaaaacttatgcaagtttctaagggcccggaaacaataatcggttttccttttcttcaaaattcatctgctagtttcttctatatatagatcaaatcaacttttagtaagaaggaggaaaagatatggaaattatatctaacgctgccaacggatttattaagctattccaggagggcggcaccacatttatgggatgggttaccggaatcattccattggttgtctgcctgatgacagctgttaactcagtgatcaagctgatcggagaagagagggtggaacgcttcgcgcagaagctgaccagatttgcagtactccgctatacgctgctcccgatcatcgcggtgctgttcttaggaaacccgatgtgctataccttcggacgtttcgtagaagaaaaatacaaacctgcttattatgactcctgtgtaagttttgtacatcctgttaccggacttttcccacatgcgaaccccggtgaactgttcgtatacaccggtatctcagccggtatcacgaagcttggcctgtccatcggaggacttgccgtgagatactttatcgtcggtgtgatcgttattctgatccgtggactgctgacagagcagatctacttaagaatgacaggaaaaacaaacaaataatctgtgggaggaggaaagagtatgtataagacaattacgatcaaagccggagacggcggttggggaggacccctgacaatcactgcaacagaaaaatgccacaagatcttaagtgtaaccggcggaggaatccacccggtagctcagaagatcgcagatatgactggcggagaagcgttagacggatttaagacaacagcgccggacgaggaagtgctggtcgccgtagtggactgcgggggaaccgcaagatgcggcgtttacccgaagaaagggatctttaccgtcaatctgatgccagtagggcaggcaggaccgctcgcacagtttatcactccggagatttacgtgtccgcagtgacagaaaaatgtatcgtggaatctgactataaaggtgtaacggaaacagccaaaccggcagccgcagaggacggaccaaaatccaaagaccaggcgaaagaagagattgcagctgcaaacagcggcaaaaaagaaggaatcatcgttaagatcggaaaaggcgttggaaacgttgtcagcaagttcttccaggccggccgtgagaccatcgagatgatcatcaaaaacgtgctgccgttcatggcatttacgagtacccttttgggtatcatcagtgccagcggattaggaaatatcatcgcaaagacgatctctccattatgtagtaccttgccgggaatgcttggtatctcctttgtgtgtgccctgccgttcttgtctccgatccttggacctggagccgttatcgcacaggtagtcggaactcttttgggagcacagtttgcccttggaaacatcccgccgcagtatgcactgccagcactgtttgctatcgatgcacaggttggtgccgacttcgtaccggtaggattaagccttggagaatcagagccagagaccatcgaaatgggtgttccggccgtattattctcaagaatcgtaaccggacctttagccgtattgatcgcattcgccttcagtatcggaatgtactaaaaacggaggtaaaaagaaacatatgaaataccagtcaaccatcacaggtctgggaccggatgctctggcgttcctggccgatgaagatatgaactttattatcatttttaacgaagatgcaccgcctgaactggcagaactttctgtccttcatacgaaggctgaattaagggctgtgccggaagtcggagacactatgacgatttgcggcaaagagtttaagatcagcgccgtgggcagtgaagctcctcacactttggcagagttaggacactgtactctgagttttaaagggggcagtgaggcggaacgcccgggatgcatcatgctggaaggaaataaacttacagaggcagaccttcaggccggcggaacaattgaaatctgttaattaaaaaaggagatagttgttatgttaaatatggacaaaaaactgattaagagacaagaagacggacagatcattaaaaccggtatcgtaggagccggccagatggggcgcggaatggtaacccagatggtattgatgaatggcatgatgccggctatcgtatctgatatcaaagttgaaaatgcagtcaatgcattcaaatatgcgggtgtaaaagaagacgacatagcgattgcaaaaactctcgcagatgccaacgcagcaatggaagcaggaaaatatgttgcctgtgaagatgcaaacttcgtatctcaggcaaacctggtagagtgtgccatcgacgcaaccggtgtgccggatgtaggagcaaaagtcgctactgacgccatgaagaacaaaaagcatgtggttatgctgaacgttgagactgatgtcgtaatcgggccatacttaaagaaactggcagcaaaagaaggtgtcatctatacaggatccgcaggagatgagcccggagctgttatggaactttacagctttgcaaaagctatgggaatgaacgtcgaagtcatgggtaaaggaaagaacaacaaactggactatgactgcaacccggatactgtattagaagaagcaaccagaagagtcatgagtccaaagatgctctgcgcattcaaagacggaacaaagacgatggtagagatgacagcaatgtctaactacacaggattagtaccggatgtgatcggaggacacggaccacagacttcaccgggaaccgaaggaatcaaagaattaaatgatatcctgaagcttaagaaagacggcggaatcttaaacaaacatggtgttgtagagtatgtaaacggagttgctcctggagtattcgtaaccgtatccacaccgaacgaagagatcgcataccagatggcataccacagcatgggacctggaccgctttggaccttataccgtccataccacttatgtaacttggagacaccgcttacggtagcaaaagcagtcatcgacggagaagtgacctgtgtaccgatcgacggattagtatctgagtgtattacaagagcgaagatcgacctgaaagcaggccagaccatcgacggaatcggaggattcacaacacacggatctatcgcggaagcaaaagaatctgatgcgaagggatatgtaccgttcggacttgtaacaaacaaggcagtgatgaagagagacgtgaagaagggtgaactcttgacatacgatgatgtggaattagataagtctactctgatctaccagctgagaaaagagcaggacgctatgtacggaagaaacgttttataatcagtacaaaattaaaaaggagccttgctgtaaggctccttttgtgcttaaaccagcgccaaagccgtctcttcgtctgtaaaaaacgaattgacgagctttaaattcaaggctacatcaatgatctgtactttgtggagtccgtcggctacaccgatggaaacccgtgcatttttggcagccttaaagatatctgctttgattagatgttttgttgcctcagtttctacagtttcaccttctctggtgaggaactgaagggccacatcaccgatggcgtgtgcagctttcagttccgcgatctcctgatcattcaaaatgttgtagcaggtgagaatcgttgattcaaaacttcccagacccatgaggagaatatccgcatgttcacccaaattaaggatctgccgtgtgtgttcattggagatcagggtttcatattcttctttggaagaacaaaaggcaggaatgtgaagcatttttgcggttccgccgatggtatttgccagctggagagtgttataggtgggaagcgcctcgaaggattcaccgaagcttccggccagagggacagtctgtacatccggaaagctgatgggatgcagttctttaataaaacgggacacggcatttccccagcccacaccaacaatgtcctttggcttcagctgtgagatgaagtaatccgcggcagcctgtgctacataatctctgttttgatcttttgtgctgatgacgcctgcataacttaagccgtatttttcttttagtgcttcctcaagctggctgtttccggttacaggggaattgatttctatctttacgatgccaaggtcttctgccctggacaaaagcttggagacccagggccttgagatacttaatttttttgcaatttcctgctgggacagcttgttcttataatacagagttgcaaccagaacgatcttgtccagcatattatctggattttctttcttcttcatagggtaacctctcgatcatgaatttattaaggcacatatgtaactatatgataagaggattataagccatttattcagggttttcaaggtttttgtgaaaaaatatattttagtattgacgaacatatgtaaagtgattataatgaagttaacaaaagcaattaataagcacatatgtaactggagaggatgagacaaaacaaaagatgaagaatacaccacggaacgttaaatgaaaggagccaaactgtatgaatggtatttcggtttttttattagtgattttcgtattgtttgttgttcaggctgtcgggggatattttcaggtgaaggattaccgcagagcggtaaggagggtacataagcttgggaatgtcggaatcggccagaagaaagggaggctgctttcaggaaacattgtgatgatcgcctgtgaccagaacggagtgatcaccggcggggagatcatggaaggattaagcttcctgacaaagttcaaaccaatctctgagtttctgggaaaggaactcgtcggaacgagtatttatgagtaccttgacgaagtcagaaactttgagaaaaagagacggaaatattacaaaggatatatcagagctttagaagctttggatatgagatttcagggaaataccttgtaatctgaaacaagatatatagaacggctgaagagagtaaaacttatgcaagtttctaagggcccggaaacaataatcggttttccttttcttcaaaattcatctgctagtttcttctatatatagatcaaatcaacttttagtaagaaggaggaaaagatatggaaattatatctaacgctgccaacggatttattaagctattccaggagggcggcaccacatttatgggatgggttaccggaatcattccattggttgtctgcctgatgacagctgttaactcagtgatcaagctgatcggagaagagagggtggaacgcttcgcgcagaagctgaccagatttgcagtactccgctatacgctgctcccgatcatcgcggtgctgttcttaggaaacccgatgtgctataccttcggacgtttcgtagaagaaaaatacaaacctgcttattatgactcctgtgtaagttttgtacatcctgttaccggacttttcccacatgcgaaccccggtgaactgttcgtatacaccggtatctcagccggtatcacgaagcttggcctgtctatcggaggacttgcggtgagatactttatcgtcggtgtaatcgttatcctgatccgtggactgctgacagagcagatctacttcagaatgaccggaaaagcaagcaagtaacagaaagggggatccagtatgtataaaacaattacgattaaggccggagacggcggatggggcggaccattaacaatcaccgcaacggtaaaatgccacaagatcttaagtgtaaccggcggaggaattcacccggtggctcagaagatcgcagatatgaccggcggagaagcgttagacggatttaagacaacagcgccggacgaggaagtgctggtcgccgtagtggactgcggaggaaccgcaagatgcggcgtttacccgaagaaaggaatctttaccgtcaatctgatgccggtagggcaggcaggaccgctcgcacagtttatcactccggagatctatgtatccgcagtgacagaaaaaaatatctttgaatctgattataaaggagatgcagcttcgaccaaaccggctgcagcagatgaaccgaaaagcaaagaccaggcgaaagaagaaatcgcagctgcaaacagcggcaaaaaagaaggaatcatcgttaagatcggaaaaggcgttggaaacgtcgtcagcaagtttttccaggccggccgtgagaccatcgagatgatcattaaaaacgtgctgccgttcatggcatttacgagtacccttttaggtatcatcagtgccagcggattaggaaatgtcatcgcaaagacgatttccccactgtgcagtaccttacccggaatgctcggtatctccttcgtgtgtgccctgccgttcttatccccgatccttggacctggagccgttatcgcacaggtagtcggaactcttttgggaacacagtttgcccttggaaacattccgccgcagtatgcactgcctgcactgtttgctatcgatgcacaggttggtgccgacttcgtaccagttggactgagtcttggagaatcagagccagagaccattgagatgggtgttccggccgtattattctcaagaatcgtaaccggacctttggcagtcttgattgcattcgcattcagtattggaatgtactaagaagtatagaagcaaaaatggagggtaaagacgaacctatgaaatatcagtcaaccatcacaggcttaggaccggacgcattagcgttcctctcagatgccgatatgaactttatcattatattcaatgaagatgcaccgccggagcttgctgaactgtcagtcttacatacaaaagctgagctgacagaagaacctgcggcaggagacaccatgacgatctgcggcaaagagtttacaatcagcgccgtaggaagtgaagcaccgcataccttaaaggaacttggacattgtacattaagctttaagggcggaaccgagccggagcgcccgggatgcattatgctggaaggcagtgcattgctgccggaggacttgaaagccggcggcacgattgaaatcaggtaacaatctaacaatcatacatagaatttaaggagattgatgttatgttaaacatggacaaaaaactgatcaagagacaggaagacggacagatcattaaaaccggtatcgtaggagccggccagatgggacgcggaatggtaacccagatggtattgatgaacggtatgatgccggctatcgtatctgatatcaaagttgaaaatgcagtcaatgcattcaaatatgccggtgtaaaagaagacgacattgcgattgcaaaaactcttgcagatgccaacgcagcaatggaagcaggaaaatatgttgcttgtgaggacgcaaacttcgtatctcaggcaaacctggtagagtgtgcgatcgatgcaaccggtgtgccggatgtaggagcaaaagtcgcaactgatgcaatgaagaacaaaaaacatgtggttatgttaaacgttgagactgacgttgttatcgggccatatttaaagaaactggcagcaaaagaaggtgtcatctacacaggatccgctggagatgagccgggagctgttatggaactttacagctttgcaaaagccatgggaatgaacgtagaagtcatgggtaaaggaaagaacaacaaactggactatgactgcaatccggatactgtattagaagaagcaaccagaagagtcatgagtccaaagatgctctgtgcattcaaagacggaacaaagacgatggtagagatgacagccatgtccaactacacaggattagttcctgatgtgatcggaggacacggaccacagacttcaccgggaacagaaggaatcaaagagctgaatgatatcctgaagcttaagaaagacggcggaatcttaaacaaacatggagttgtagagtatgtaaacggagttgctcctggagtattcgtaacggtatccacaccgaacgaagagatcgcataccagatggcataccacagcatgggacctggaccgctttggaccttataccgtccataccacttatgtaacttagagacaccgcttacggtagcgaaagcagtcatcgacggagaggttacctgtgtaccgatcgacggattagtatcagagtgtattacaagagcgaagatcgacctgaaagcaggccagaccatcgatggaatcggaggattcacaacacatggatctatcgcagaagcaaaagaatctgatgcgaagggatacgtaccgttcggacttgtaacaaacaaggcagtgatgaagagagatgtgaagaagggtgaactcttaacatacgatgatgtggaattagataagtctaccctgatctaccagctgagaaaagaacaggacgcaatgtacggaagaaacgttttatagtttcatagcaggaacagaacaggaagaagatgtcccggaggtctgtgtttgtctgacggacctgacctctgagacattctcaattaaggaggaaagagaagatgcttgtaacttcaaaggaactgtttaaaaaagcacaggaagggaaattcgcgatccctgcaccaaactttattgatcttgagtctctccactggcatgtggaaacagccgaaagacataatctcccgctgatccttgcactggctgaggcacatatcggagaaaatattacattggaagatgctgctttggtaggaaagaaatatgccgaggaagcaaaagtaccggttgtacttcatctggatcacggaactacaccggaagtgatcaaaaaagcaatcgatcttggattttcttctgtcatgattgacgcttcacaggatacttttgaagaaaatgtaagaaaaactaaggatatcatcgactatgcacatccaaagggagtggtagtggaagcagaaatcggccatgtgggagccggtgaaaactatgagaaccatgagacatccgattctcagtatacaactgtagaagaggcaaagaagtttgccgaagagacaggtgtggattcacttgcgatctctatcggtacagcacatggaatgtataaaggcattccggaaatcaattttgacagactgaaagaaattgctgcggctgttgacactccgcttgtccttcacggaggatcttcatcaggagatgaaaacttaaaccgctgtgcaacaaatggaattacgaaaataaatatcttctctgacctgttagtggccgcaaaagaggagattgacaataataaaccgaaaacgtatctggatgtaaaggcattgtcaaaacagggaatgcagaaatgtctggaacactattatgcagtatttgaaacaagggaagcttaatttccaagctgtaaggaggataatcaataatgaccgtatataaagaacaaatcagcctgaactctcatggcacgacaccgacttacctggatatcacccctcaggtaaaggaagcaatcaaaaacagcggaatcaagagcggaacctgtaccgtcatctcacctcacacaacctgctctgttttctttgaagaatttgtacatgattataatgaggcaggggatgaatttctccaggaagatttaaacaatgtgcttgaaaagatcattccaaatcaggattctaaagatctctacatttatccgggagaaaaacattatgaggctgtggaggcatggccgaacgctgcagaatatcttccggacggggacagaaaagccctctggaactgcgacgcacatctgaaagcaacacttcttggctccagccaggtgtttgacgtagaagacggaaaattaggtgtcggatccacaggatatgtttattttgtagactttgaccgcacacgtgcccgcacaagaaaatgcaagatcattgtaatgggcgaataggaagggatggcataagcatgaagagagaactgagagtaccatttttaatcgtcaatccaaaagcatatatttacggagaagaatccttagaacttgcaaaagtttgtgaccagcttgccgaggaatatgacattgacattatctttacaggacagcatgtggacttaaaacagatcgcacaggagacaaaaaatttgatcgtgacaacacagcatatggacggattagttccgggaagaggaatgggattcatccttccggatgcgctgaaagcagccggagtggacggtgtgatcttaaaccacgcagagcatccgctttctatgtgtgacttggataagaccatcaaacgtgcaagtgaactggatatgatcacgatcgtgtgctcagattcagtggaacagacaagagcggttgcagagcttgggcctgatgttatgatctgtgaacctaccagcctgatcggaacaggaagcacaagtgatgacgcatacatagaagctacaaatgaagcagtgaagtccgtaaatcctgacattaagatcattcaggctgccggagtgagcaccggggacgacgtctacagagtcgtagtgggcggagctcacggaagcggcggaacaagcggaatcctgaatgctcctagcagaaaaggaaagattgaagaaatgcttcaggcgcttgtgaaggcgaaaaaagaaatataacattttccacatgatttccgtttggctcttaaaatgcctcactttagtcatgcagaaaatggacgtaatgtctactgaatagattgctggaaaagttctgtatcctgagaagatacagaacttttttgacgggtttcatcaaattgatttttgtcaagtaatattatataatttacattaataaaaaggaatcgttctgctttcggaaaggatttttatgttatctttattcctgtctttcttatttccgaggcgctgcccgatctgtcatcatctcttaaaaaatcagcaaagccttatttgccccaaatgttatcaaaaggtcgtctttgttcgggagccggcctgtttttgctgcggaaaacctctggaaaacgaagaaacagagctgtgcagtgactgcagaaagcatccgaagacatttaaaaaggggatccctttgtgtgtgtataacaacgaagtgagggattccctggcggcgatcaaatatcaaaaccagaaggaatatgcggacttttatattatggaaataaaaaagaggaaattaaaacagctgaaaaatttgagaattgatctgatactgcctgttccgctccacaaaaggaaaaaaagaaagaggggatttaaccaggccatgctgtttgcagaaggtatcggagagatcctccatgtaccggccagtgactgtgtgctgttcaggaccaaatatacaaagccgttaaagtcgctgaatccaagggagcgtctggcatccatggaacacagcttttgggcttctgacgaagtgaaggggaaaagggtgctcttagtggatgacatttacacaacaggggccacggcagaaagctgcacgagggccttgaaagcggcaggtgcagaagacgtatgggtgttttgtgtggcaatcggatatggagaataggagggactaaagcagaggatagaaatcctgatttgatatcctttccattattctcacagtagaaatctatcggtttccctgatataataaagctttgcgggctgtacacagatgtgtaaggaaattatttgactatgtcaaatctcatctggcacgcaaagtttaaaagactatgagctgaagtgggcttgcccactttgttcggtatagaagggactttgtaatggaattgaaaaaagaaatcggagaagcgctgcttttctggtatgaccataatgcaagaatcctgccctggagagcggataagaatccataccgcatatgggtttctgagatcatgctccagcagaccagagtggaggcggtaaagccttattttgaccgctttatggaagaactgccggaggtaaaggatctggcggaagtagatgaagaaaaacttatgaaactgtgggaggggctgggttattataatcgggccagaaatttaaaagctgcggctcagaccatcgtaaaagagtatgacgggaagcttccggatgactatgatcaactgctttcgttgaagggaatcggtatgtacacggcgggagccatcgcctctattgcttatgatatccgggttcctgccgttgatggaaatgttctgcgtgtcatggccagactcctgggtgatgattccgacattctgaaagaaaagacaaaaaaagagatggcggcaagagttatggagatcatgccggaccaaagggcaggagattttaatcaggctctgatcgaactgggggctatcgtctgtgtgcctaacggagaaccaaaatgtagtgaatgcccgtgggacacggtctgtaccgcatacagagaggatctgaccggcaggctgccggtgaagaagccgaaaaagaaacggaagatagaaaagagaactgtgttcgtcattgagacggacagtatggttgcccttcataaaagagaagagaaaggtcttttggcgggactgtgggaatttccaaacatactcgggaagtgcagccaggatctggtggaagaaacattggacggctggggaatgtcagactgtgtttatgaatttacccacgaggggaaacatattttcagccacattgaatggcagatgacaggagtgttggtttctctgaaagaaccggtggagttagaagaacttacatgggtcagcaagaaagatttagaagaggaatacgccattccgtcggcatttgaaatgtttagggagtctttacaatctgcctattaaagggtacaattacagaagctatatattattataaggtaaggagagcagcaatgaaaaaattaatagcagttgcgctgtctgcagttgtctgttttggtgtgctggccggatgcggcagctccaaaaaagaggacaagacaatcgtagtcggtgcgagtccatcaccacacgcagacatcttgaaggttgcggcaaaggaactggaaaaggacggctacaagctggagatcaaagagtattcagactatgtacagccgaataacgcattgggatcagaagatctcgacgccaactacttccagcacatcacctatctgaaaaattttgcgaaggaacacaagctggatctggtttctgccggaatgatccactatgaaccgttcggtattttcccggggaaagcaaaatcactgaaagatgtgaaaaagggtgcagtgatcgcagttcctaacgacactacaaatgaggcaagagcattattgcttttggaagcacagggcctgatcaagctcaaagacggagcaaccctcacggcaaccaaaaaggatattgtaaaaaatccgaaaaacatcgagatcaaagagctggaagcagcacagctgccgcgttctttaaaggatgtggattttgcagtcatcaacggaaattatgctttgcaggccggcatgacagtaaataaggacgccctcgcagtggaagatgaggagtctgtgggcggagcaaagacctacggaaatgtcgttgcagtcaagaaaggcaatgaagacaaggactctattaaggctctgatcaaagcattaaagagcgacgcagtaaagaagtatatggagaaagaatataaaggcgcggtcgtaccgttattctagaaccattgcgataaaactaagtttaagaaggagaaaatcatgagaaaaattttaaccgtagcactggctggtgtattggcagcaacaatgctgtttgcaggatgcagcaaaaaagaagaagcagcgatacctgaaaaaattattgtgggaacaaatgcggaatttcccccatttgaatatgttgatgataataaaaagatcgatggttttgatattgcaatgatgaaagaaattgcaaaacgaatggatgtcaagatagagatcaagaatatggaattcaaatccctgattggttctttggaatctaagacgattaatgcggttgcagccggaatgacaaaagatccggagcgtatggaagcggtcgacttttctgacagttattatacaagcagccaggttatgattgtaaaaaaagacagcaagctcaaaaagatgacagaactaaaaggaaagaaagtcggtgttcaggaaggaacaacaggagacaagcttgcaacaggagaaaactttggggagaaacagaaaccggttgtcaaaggcgtggatgtgaggcgttttccaaagggtgtgaatgctgttatggatcttaaaaacggcggagttgacgcggttgtcatcgatgaaaaacctgccatggagtttgtaaagaacaacaagggtttaaagatcgtcagagataaagcagcagaagaatactactgcatcgctcttccgaaaggaaacgagaaattggtaaaagagatcaataagcagttaaaagccatgaaagaagacggtacattagacaaactgaaagcaaaatatatcgataagtaacaggatggaaaggtaagataaattatgagtttagattcattttataaggcatttatctccgggaaacgttacctgatgtaccttgacggtttgaaaatgacgattcttgtttctgtacttgccatcctccttggcgttgccctgggaacggtattggcgttgatgcggctgactgcggagaaaaaagggaaaagtacggttttatctaaaattgcatacgtgtacattgacattatacggggaacaccgactgtcactcagctgatgatcatgttctttgtaatcttaaaaggtgtggatggactgatcgtgggaactgtgacttttggtttaaacagtgccgcctatgtctcagagattatccgtgccggaatcctggcagtggaccagggccagatggagggcggacgttctctcggattgtcatatggacaaaccatgaaagatattatcttaccgcaggcaatcaaaaatattcttcccgcattgggaaatgaatttatcgtattgatcaaagagacagcgatattaggatatgtatctatcgttgacttgagcaaggcagcagactttgttatttccagaacatatgaagcgctgacaccgctgataggaacggcagtcatttattacttaatcgttaaggtgctgaccttagttctcaatgctgtagaaaggaggctgagacagagtgataaacgttaaagatttacacaaatatttcggctccctggaagtcttaaaaggcattaactgccacattgaaaagggtgaatgtgtctgcatcatcggtgcatcgggatcagggaagagtacatttttgcgctgcctgaaccttctggagacaccgacaaaaggggatatcaacattgacgggattaacattatggaaaagggctgtgatgtagatgagcttcgcagaaaagtgggaatggtttttcagcatttcaaccttttccctcatctgtccatcctggacaatgtgaccttagcgcctgtcaggcataaaatgatgacccaggacgaggcgaagaaaaaagctatggagcttttgaaccgtgtaggtgtcggcgacaaagcggacaactatccggtgcagctctccggaggacagaaacagcgtgtggccattgcaagatctcttgcgctgtcaccggatattatgctgtttgatgagcctacatcggctttggatccggagatggtcggagaagttcttgaggttatgaaacagcttgcaaaggaaggaatgaccatggcggttgtaacccatgagatgggatttgccagagaagtggctgacagagtcttgtttatggacggcggagttatattggaggccgggacaccggaacagatatttgactatccgaaagaagacaggacgaaagaatttttgagtaaggtattatgacattttccacacgattttcgtttggctcttagagtgtctcactccaatcgtgtagaaaatggacatattatctgctggagcaggctgcttagaaatcaaaggtgctacctgcgatagtttttctgatactaagctgatctttatacggcaaaagtgttttaaggcagaaagattaagacgttatttataaaaaacatgttgcaaatttcggagcaacatgttttttctttagaaaattatttctggctgctggagctatttagtaagtaatttattttgtgtttacaaaatattacaaatattgtataatcacaatatgagaataacacaatcagaaaagtatgaggtgtggagggtataatgacagaagtagatatttcttcatcgaatgataaagggcacataattatataccagacggaggatggacttacacatattaatgttaagatagaagatgaaactatttggctcacacaggcacagctatgcagcttatatcaaaccagcaagtctaacataagcgaacatattaaacatatatttcaggaaggtgaactggaggaaaaagcagttgttcggaaattccgaacaactgcggctgacggaaaaagctataatgtaatacattataatcttgatatgattatttcacttggctaccgtgtaaaatcaatcatcgctacgaagtttcgtatttgggcaacagaacgtttgaaagagtacatgataaaaggtttcacaatggacgatgaaagattgaagcaattaggaggaggaaattactggggagaacttcttgatagaatcagagatattcgctcttcagaaaaggtgctttacagacaggtgcttgacttatatgccacaagtgtagactatgatcctaaaagtgctcaatccattcgttttttttagattgtacaaaataaacttcattttgctgcacatgggcatactgctgcagaagtgatttatgaacgtgccgatgcaaacaagccgtttatgggtttaacctcattttccggagagataccaattaaaaaagatattggtattgctaagaattacctgagacaagacgaactgaaagtacttaataatcttgtttctggatattttgattttgctgagatacaggctttgcgccataatccaatgtatatgaaggattatatcaagcatttggacagcatactggcatctactggggaaaagttactcgaaaattcaggaagtgtaagccacattcaggcaatggagaaagcgaagaaggagtatcaaaaataccaggttcagaccgtttctcccgtggaacaggcatatcttgattctataaaatcgattgaaaaaaaagcaaaaagaaaatccagagaataaatgaaataaaataccggaaacctgtcacagttcccggtattttttagctgcattaaattgtatgtattctacacgattccctgtgctgtcatcgcatcaacaaccttttcgaagcctgcgatatttgcaccggctacgtagtttccttccatgccgtagcgttttgccgcgtcgtctaagttgtggaagatatttaccatgatattctgtaatttaccgtctacttcctcgaatgaccagcttaaacgctcgctgttctgggacatttccagtgcggatgtggcaacacctccggcattggcagcctttccaggggcaaataagatattgtttgcctgaagatattctgttgcttccagagtcgtaggcatgtttgcaccctctgcaactgcgtagcatccgtttgcgactaatgtttttgcatcctcgatgtctaattcgttctgagttgcacatggaagggcaacatcacaaggaacagtccatacgcctctgccttcatggtattctgcgcttggacgggccttagcatattcggtaaggcgggcacgcttcacttcttttacatcctttaataaatctacatcaattccgtctttgtcataaatccagcctgtggaatcagagacagttacgactttggcacctaactgctgtgctttctgggtagcgtagatcgcaacatttccggaaccggaaatacatacggtggcatctttgagagatttgccgttgcatttgagcatttcatctgtcagatagaggagtccgtatccggtagcttctgtacgtgccagagatccgccgtaagataatccttttcctgtgagcacaccttcgtatactccgcggattcttttatactgtccgaacatgtatccgatctcgcgggcacctgtaccgatatctccggcagggacgtctgtgtcagcaccgatatatttgcagagttctgtcatgaagctctggcagaatgccatgacttctctgtctgattttcctttcggatcaaaatcagctccgccctttcctccgccgatcggaagaccggtaagggagttcttaaagatctgttcaaaacctaagaacttaatgattccaagatttacagacgggtgaagtctcagaccgcctttgtatggtccgatggcgctgttaaactgaacgcggtaaccggtgtttacctgtacctgccctttgtcgtccacccagggcacgcggaatttgaactggcgttccggattgacaagacgctctaacagggcttcttttctaaacttctcttcgtttgcttcaacgactgcgcgaagagattccagtacttccttgactgcctgatgaaactccggttcagccggattctgggcaaccactttctcaattacttcatctacatatgacattgtgtatcctccttgaaacaatacttcagtattttgttttgcttggacttttatcgataacattatacaggataaaatttcataagacaatagtaaattactgctttaatgtgttaaagtaaatcgaaaaatgcatgaggaaaagatttcaagtttttttcggggtgtgatataatgagcgcagaacgccgccggggatgcggcggcatgaagaaaggaaatacaatgaaaaattcagttgtcattgcttattataatgggaaacaatatataaaagaacaagtggattcaatcttaggacagcttggagcggaagatgagctgatcatttccgtggattccgatcaggatggttccggggagctgctcagagaaatggctgagaatgacggccgtttaaaattgatcaagggcccgggccagggagtggtaaaaaattttcagaacggtctgcttcactgcacgggagatcttatttttttagccgaccaggatgatgtctggctgccccaaaaggttgagaaagtcactgcctgctttcaagaccctgatgttacagtgacagtccacaatgcgcagatttccgatgaaggattaaaacctctggatgagacgacatttcaatggagggacagcggtgcggggttttggaagaacataaaaaagaattcctatataggatgctgtatgacgtttcggcgggatatcttaaaccgcattcttcctgttccggattcaatctggattcatgaccagtggatcgggctcctcgctgaacagcttgggaacccggtatttttagaagatgttcttttactgtaccgcagacacggcgcaaatgttaccgaacttacacacggcagtgttatatccatgttaaaaaagcgatatgatatgattatgggaattaaccgtcggatcaggaggtggaagagagaagatgccaaaaagaagaaatttttatagacggaataaatatttaatatgggcattccttgcgccgtttttcatcctcgaaggaattgcagtcataatgaaagtagaaccctttgggaacaactcctttctgatcgtggatgcactgcatcaatatcttccattttttgcggattatcatgagaagctcaggtctttggacagcctgttttattcttttcatggcggcctcggcttcaactttttggggctgtgggcgtattatctttccagtccgctgaaccttattattgtactttttccaaaagagatgctgaacatggttctcagtcatctctatattataaagattgccctgtgcgggctgagtgcggcgtattatttcagatccagagataaaaaaaggcaggatatgagcatcactgcatttggaatctgttatgcactgagcagttatatcgtgggatacagctggaatattatgtggctggaagtcatgataatgcttcctctgatccttgcaggaatagaccggctgataaaaaagcgggacggaaggctttactgtgctgccttgtttttctcccttctctgtaatttttacatgtctttcatgacatgtctgtttcttgtactgtggtatttactgtatgaccacaaaaaagtaaaggacttttttgtaaacggtctgaaatttgcaggatattctgtgctgtcggcgatgatggcgggggcggtcctgcttccggcatatttgggaatcatgaaaacttcatctgcgaaatgggattttccaaaagaactttggtatggaaattttgcggatatctactgccgccatttcctgggtactgcgccgatcacaaactctgtaaacgacggggagatcaacctctactgcgggatattgacactgatcttcgtgctgttctattttatggcctcccggatttcctggaagacaaaaataaaacgcgcactgcttctgattcttttgtttttcagctttaatatgccgtttctcggctatatatggcacggatttcataatcagtacggaataccaaaccggtttgcatatttatatatttttcttctgctcattatggcctatgacgggctgctggtcatcaaaagggaaggaagagaacaggcatggaaactctgtattgcctgcggcatcttctgtatgtcagttgggatctcaagcctcctgaatacaaaagcttttgaccgcaaagttttggcactgacaacggcagcggttttcgtgtatctcctggtgtttgctctgtacgacagaaaaacgctgtccagaaaagggatgattgccatatgctcggttctgctggccatagaaacagccgggatggcagtctacggcttttctgagaacggtcaggtgctggtcactgaatatttcggggatacaaaagatatccagaaggtaaaggacaaatacaaaacaggtccggaccggcgaatggaactgatcaagggcaaaatgcttgatgagagcatttggcatacgttaaacggagtcaccatgtttgggtctacggccctcggcagtgtagtggatatcatggacgacctgggattttatacgggaatcaatgagtacctgtatgagggggcaaccccttttacaaataatcttctcggagtgaagtataatttgttaaggacatcggatacgaataccacagaatttcaatatttggaccgcatcggcaatgtaaatgtttatggaaatccatattcaacggcagttggatacggtatgaagaagtcggcgtataaatggaattatgatgacgtcaatccgtttctcgtacagaacaggctgtccggcgatgcgttcggggggaatgatatttttcatatgattaagacgaaacagccgaaaactaacgcctgcaagatcacgcagagcaatgatggggaatatgtctttgaaaataccgcaagtctttccgacaacatggtatttgaaatcccggtcacagaagatggaaagctttattttcattttgacggaagtcaggtggaggatacggccatttaccgaaacaatgagatatatataagcggccgtctgaatgcacagtgcatttattttggagatttaaagaaaggcgatcatatcactgtaaacatgaaactgaaagaagatgaccttatgtcgggtgtggtgagagtcacgctggcatctttagatgaggatgccatgaaagacctgtatgggaaaatgcaggaacaggcatttcatctgagagaatcttcaagcggcatgctgaaaggctctgtaaatatgtcagaggcaggaccggtctttttctcaatcccgtatgataagggctggaaggttcttgtggacggaaaagaaacagatgcaaagtccattggaaatgcatttctatgtgtggatgtatctggaggaaaacatgagattgagcttaaatactgcccggaaggatttaaagaaggcatcatcttaacagctctgggatggattttgttcacagtgatctgcatcagaaaacggaaaaaatccgcatagacggagaggaggccgggaacggtaaagctcccggccggttatgaaaaaattttaaaagcctagcaatcaaatgtatttaattactatggttttagtataagcagaaaatgtgaggggaatttgataggattatgaacaaactgtgaacaaaagtgtaagaaaaaaataagctttttattgctatttataagagactgatatgttacactaagcaggtaagaataatttacggaggaaaatcaagatgggaaaaagaaaagttttattcagggcggcagccctggctttggctgcggttatgacattttcatgggggccgtctaagtttgtgaaagcggacagtgtagacagcgatcagtatctggcattaggggcagatctcagttcaaaagaaaaacagacagtactggaactgctcggggtgagcaacacaagcgattatacgttgattacagttacaaataaagaggaacatgattatctgggcgattatctttcaagcaaggtcataggcagcagggccttatcttctgtcacagttaaaaagaccgacggcggaagcggtgtcaatgttaccacagaaaacattacatactgtacggaaggaatgtataaaaatgcccttgtcactgcggggatcaaagacgcagaggtaaaggtggccggaccgtttaaaatatccggtactgcggcgctggtgggagtcatgaagtcttacgagcagatgacaggaaaaaagattccggaaaagagcaaggatgctgcaaccgacgaattgatcacaaccggtgaggtgtctgagagcatcggaaaagaagatgcagaaaagctgatcgctgatgtaaaacaaaaggttgccgaggataatctaaagactccggcagaaatcggggaagctatcgatgagtctgcgaaggatttggagatcaatctttccgatgcagaccggcagaagattcaggagctgatggataagatctcagaccttaatttaaatgtggatcagctgaaggaacaggcaaaagatatatataataaactcaacgacagcggattttttgagaaggtgaaaagctggttttcgggattcgtagataccattaaaggaattttcagctaatcataaaaatttggattaaccctctttatgtctacatatattggacataaggagggattttttatggatcagaatcagatgcttttatacataatggtgggtggctgcggcctctgtgtgctttatggaatcttaaagaggccgtcctatctcctggtcctgctggccaggggagggttctgctcggctcttatattttttatacacatctattgccagaaaaacggaattcatgcacctgtagatttaaacatagcttctataggaacgggagcactcctgggactgcccggtgtcgtcgtgctttatgtgctgggatgtattgtatgacatttttaccagttctgcggcttgctgtctcaggaaggtaagattttctaactttcagcaaagtctctccggcggcccgttcggaactcgctgacgctcagacagcctcactgcgcttcacgcaccgcctccgaaccttcgttgaaagaagaaaaactaaccttccttcgaatgcaatgcctccgaactggtaaaaatggacataatttctgctggacaagccttccttgaacaaaagaagctatccatcgatcgtttttaccacttttccgtttggcccttaaatgcatcactctaatcatgtagaaaactaatttaaatgatttttgctgtaaaaaactgcactggaaggtgcagttttttggtgttcagatctctgcagttcatcttgaaaatatttggttttgcgcagattttcatacaatcttataatgggtttaaggagggagaaagggtgaataatcgattaaaaactattttcttattcttaattcaaaatgacgatcaatacatcacggtgagagatctttcgcggagattttccatcagtatgaggactgcttataatgacttgaatcggatcggtgattttctttgtgaaaacggttttatcaatttgaacagagaaaaaaacaagggaattttgcttcgcctggataatcaagaaaaaaggagacttcagaaaatgatatggagcggggaagaccaaaatatttctcccagggaacgaagcattaagatcactcgttatcttttggaatgccttgattatattactattgatgagatttccaatcattttcaatattcaaggaatacgattgtcaatgatctgaaaaaagtaaagggatggatgagcggacatgagcttaaattggtgacttatccatacagagggatctgcattgaaggagaagaacactccgtaagagctgcatggactgcgtgtcttacggaagaaagacaggggaagaatttgatcaacgagccgaaattatggggcacagtcataggaaaagacgaagcgctaaagctgattcagactgtctctgacctggaagaagagcttcaaacaaggctttctgatgaagcttacagccggattgtcttttctctcggattttctttatataggatcagaaatgacagagagatagaggaagactttctatatcccggtttggaagaatcaaacgaatatcagatcatttcaagaaggggaagggaacttgagaaaaaattcggggttttcttttcggaaaaggaaaaagcgtacctttcgtcactttttattgcgagcagtctgcaggatgaaaaaaatttcggcaaaattgtgaaccaatggctgcctcttcagatcgtagtcagaaaatttatcaaggccatggaagaagaactcggtgtagaactgatgcaggaccgtcagctgttttatggactgctggcacatttgaggccggcgtattacagaattctctgcggcatgcctgctgacaatccgatgtatgaatatgtcatagaaaattttagattcattcatgaaaaggtaatggaacagatttgtctggcagaacgggacctgggaatcttatttcccgaagaggaggtctcatttctgacgatctgttttgcggcagcactggagaggcagaagaagaaaaagaaaaggattccccgggtcatggtggtatgcagcacgggaacaagcacatcacagatgctcttgtcccagctgaaaagcagatttcaaatttccctgcttggggcgtttccggccagaaaggtggatgatattttagagagtcaggaagtcgatctgatcatttccacggtggaactgatccgcgacaatgtaaagatcataaaagtcagcccggttctcagtgaaaatgatatggcccggctgagtgaactgctcggttccatcgacacaaaaatcagtgtagacaagattttggagattatgaaacgtcatggaatgatccgggatgaaggaggactgaagagagaacttgaacagtattttaaatccgaaactacagagttaattacgacaggaaaggacagagatccaatgttgatagaagtgttaaatgaagacttgattgaaacaaatgcagaaatgaaaaccagagatgaagcggtgagagagagcggacggctattatgcagccaggggtttgcggaggagaggtacatagacgcgatgattcaaaatgtgaaggaaaacggcacttatatcgtgattgcgcccggaatcgccatgcctcatgcaaggcctgaatgcggtgcgaaaaagatcgggatcagccttatgacattgaaggagccggtcgtattcggccacaaggtcaatgatcccgtgaaaattgttataggcctttgtgcagtcgaccaccagacacatctgacagcgctctcggagctggtggaaatactaaacgacaaggagaaaatagaattaattttaaaggccggatcacccaaagagatcatggatgttgtaaagaaaggagcagccttatgttgaatattgtgacagtgtgcggagcaggagtgggaagcagcatgatgatgcgtttgtatgcgcagcagagtttatcggaagaaggaatcgaagcaaatgtggaggcggcagacattggttctgtcaatcccgatgcctttgacattgtgatcaccacgtctgattttgcagaccttcttcatgcgtcaagagcaaagattgtgaggatcgataatatgatggacaaagcatatttgaaagaacagcttttaagaacaataaaagaaatctaggcagtgattagagaaaggataaaatatggatatattaatgtacctgatcaacaacgtctttaatcaggcggtgtttgtcataggaatggtcgtttttctgggaatgctcgtgcaaaaaacggagatgtctaaaatcattgcgagcacggttaagacaatgattggattcttgctgatcaatacaggaggacagacgcttggggctgcactgcttcctcttcagcccatgctcataaaagtattccgtcttcaggtaaaagtacaggatctgggggccgcacaggcagaaagccttggagacataggcagtgagatggccttgatctttgcccttggatttttaatgaacattttgctggcgaggattacgaaatttaagtatgtacatctttctgcccatgtctcatttttcttttccggactgattgcggcggcattaaaatttgggacaaatttaagttttataccgttagttctgttaggcgccgttctgttagggagctatatgacctttacatgtgcctatgtggcacctctgatgaaaaatattaagggaggagaaggatttacccttgcgcattccagttcctgcggtatctggctggctgcaaagatcggcggactcgtgggcaataaagaaaaggatttagaagatattaaaataccgaagaaattaaatttcctgcgggaaatgacaatagcacttacggtcgtaatgactttgatgtttttcgtgatttctctgatcagcgggccgggatgggttgtgcagcaggtcagcgaaggcagggatattatcagcttttccctgctgaacggattacagtttggactctggattacggtgatcatcacgggtgtcagaatgcttttatcagaaattatccctgcattccatggaattgcagacaaagtaattccaaacgcagttcccggactggatgtgccgcttctgtttcccaattatccgacttccgttatttttggatttctggtgagcctggccgcaggatttatcggcatgggaatcttaggagtagtcaattatccggtcgtcgtatttccggctctgatccctacattttttacaggggcagtcacggctattttcgggaattccacaggcggaatccggggtgcgtttgcaggttcgtttttgaacggactcatcctgatcataggtcaggcacttctgcttccgatgatcggaacctatgctccgattatgaggatattaagtgagactgactattgtttatacgggccgcttttaggaggagttttaaaacttctgggaggcatttaaatgaaagatcttgtattgtatatgaccatcggctatcctgatgaaaatactttttttcgaatgctggatatgctggatgaggaaaaagttcctgttttggaattggggattcctgttgggaacccatttgtggacggtgatctgatcaggcaaagccataagaaggtgctcgattcgggaattggacaaaaaaagatcataaggtggcttcagagaatacggagggattataaattctgcatcatactgatgacgtataaggagggtatggaaaggttctgtttatctgaactggacaaaaatttatacgacggcattttatgtgtggacgaagtgataagggcagataccgggatgagaccggttcagatatataatgaaactatgacggaagtccaaatgctcagtctattggccgagaataaaaattttgcatatgtcatgagcggaaatgggaagacgggatctttttcatgcctgccggacggatataaaaggaccgttcactttttaaagaaaaatacaaacctgcctgtctatgtgggatttggcataaagacgctgaaagacgtgaatgccgtgtgcagccatggggcagacggagtgatcatcggatctcattttatgaggatcatgagtgagaagggatatttggaatgtaaaaaatatataaatataataaacaattatttacaaaaaacagctttacaaccataaagaataattgtaaaataataccataggagggaggcctatggtattattattttatctcacagccgccgtgatctgggattttacaacgttccggataccgaattattttattttttttggactgatccttggagcttcgctcctgccgtttcgcggttacggcatacaggaaattctgctggggtgtctgtgccccgttgttttcttatacccgctgttttgtatgggtgcctttggcgcgggagatatcaagctctttgcggtcacaggattgttcctcggcggattaaatatctatcttgtagcggtatcttttgccgccggaggtgttctttctctgtttcagatgttatctgacagaagtctgattccgcgtcttgtctgtttctattcctatctggccggctgtatccatgaaagaaagttcatgacgtatccgtcttattcccctcagaaaaagaaaaatcaaattcattttaccgcggcagtgatgatcgggtatctgatgctgtgtgcctggaaggagtgcctatgagccatatttttatcggaatctatgatgaagacgctgtttacggaaaacggctgatggagtatatcaaccggcagaaagagtatcctctcacagcggcggcgtttgcttccttcgaagcgctcacggaatttatcgccagtcaggatgtgaaaggtgtgattcttgaggagggaacacagatcaacagtaaagtaccggtttactatctaaagaaagagcccttaaagggggcatgccgatatggaagtgcaaaggagatcgtgaaggaggcatacgcagttttcagtccaaaaggcccggaatcaggcggtgtgacaggtgtctactctccttctgataatttgagacgtaccggatttgcgcttgagaccgcagtaaaacgcagtgcactgtatttaggtatggaagcttacggatatgccgttcaaaacaggagcatggaggaccttctgtttgcggtgaaggccaggagggagaatatcatcgattatgcgcaaagtctgatctcgggcactgacggagtcaaaatgatcggctctgcccgatgttttatggactataaggacatgtccggggaagattaccggtggttttttcagcggctggaagaagcgggaatatatgccgtattagatatgagcacagcctgtatttatgattttgaactgttctcgctttgtgaccgtctgtatcttccgatttgggaagaagatatggaagatcccaggcttttgggatttaaagaactttctaaacagcaccctgtactttcgaaactgcactggaaggaggtatatttatcagagacacagaaccaagcagacaggacgaaatgttctgcagagagaaattaaaagaaagagtgcttcacagagctgaccttatctgtgatataagcgacaggcagcttctggaattgatagaggaagagctgcagcagatgtcagaagaaggatatctgccgctgaagtataagtacgaactgctgaaagaggtttataactcgctgcgcagactggatattctccaggatctgctggacgatacttcaatcacggagatcatgatcaacggatatcaaaatgtatttgttgagatcgccggaaaactcaggagatgtcataagaagttttcttccgaagagaagctgtatcaggtgatccagcagatcgtggcaggggccaatcgtatcgttaatgagacgaatcccatagtagatgccaggcttcccgacggttcaagggtcaatgtaatgctgccgccagtctctttgaatggtgccgctatgacgatcagaaagtttgcgggggaacctatgacgatggaatggctgcgggaaaaaggggcctttacacattttacggagcagtttcttgagattctcgtcaaggccagatataacatctttatttcaggaggcaccggaagcggaaagacaacattgctgaacggaatgtcaaactgtattccgaaagatgaacggatcatcacgatagaggactcggcggaactgaaactcaatggcattgagaacctggtccgcctggagatgagaaatgccaatattgccggggagaaccagatcacgattgcacagctgatcaaggcagcgctcaggtcaaggcctgaccgtatcatcgtgggggaagtgcgcggagaggaagctttgtcgatgctgaatgccatgaatactggacacgacgggtccatttccaccgggcactctaacggacctgaggacatgttgagacgtctggaaacgatggttctaatgggagtggagatgccggtttcagctatacggggacagatcgcatctgccattgatattatcattcatctcggcagagtcagagacggcagcagaaagctgatggagatcgatgaggtccttggaatctgcgacggtcaggtgaaacttgcaaaactgtttacgtttgatcagcaaaaagggctctgttttgctgaaccactttacaatacgaaaaaacttagggagtatggtcagtatgaagcttataaagagttattatctcagcagaatcaaggaggtaaacatccttgaagtgtttaatatacgaaaggctgtgctgaaagcggcgcagggaatgattctgttttttatcatatgttatctcttttatgaccggatctggctcgggatcttatatgcagtgttttgtttcccatatatgctgtatcaggccagggaggagagaaagatgcggatcagacagtccaggctggaatttaaagagatgctgctctccgtctataacagtctgagcgcgggatactctctggaaaacgctgtgagggccgctcgggatgatatgagagcagtcaatggagataagaaaagtgtgctggaacaggaactctcgctggtgtgcgcgggactggaggtaaatcagcccatcgaagtgctgatggataagatggctttaaggcttggtgtggatgaagcatcgcagtttgcacaggtgctgtggattatcaagagaaacggagggaatctgatccagattatcaaaaagtccgtggagcatatgaaccagaaaatacaggtcaaagaagaaatccttacgatggtatctgccaaaagaatggaacagaagattatgtccgtgatgccgttttttattcttttgtatgtgcgtcttatgaacccgggatattttcaggttttatacgattctccgggaggcgtgatattgtcgacggtttgtctgattgttttagtcgctgcaggaatgtgggcaaaaaaaattgtggaaatcgaggtgtaacattgatagaaaagtgggtccgtcatctgccggagacagctgtcaggaacaggagggagtacatccgcagctacttctgcggcagcagggaggaacaggagaaagaggtttggcgttcactttccgaacagtggagaaaggtatttctcgcagcatgtgtatttctcggggttatctttttggcggcagggtcggaatggctgggagcaaaagatatctccattcacagggacagagacggagaagaattaaaccgggaactgaatattgatacaggcaaagaaaaagaatcctatgatctgatcattcatcctaaggcatacaccgaaaaagaagaaaggaaagcctttgataaggctaaaagttacctgaaaaaacatatgaaaggtgataatccgtctttaaatgaagtgaaaggccggcttcatttcccggagcagattccgggaaatcaggtcaaaatcagctgggatacaggggatctgagtctgatcgatgaggcaggcaatgtatttaacgaagatttaaaggaacctgtgatcataaaagtgaatacctctctctcatacggagagcacagagaaatgatcatgactccggtccgtctggttccgggacaagccgataaaaaggggacgaagatcgacggaattaaaaagaaattagaacagattgagaaagaaaatgcaggaaaagatacgtttcgtattccttcaagtataaacggcagcgagattacagaggcggataaggggaatggccgtcttccggcactggccgcgataggcatcctctgtctcgtgcttctgtggtacacagaggaagaaagacagaagcagaagaaagccaaggcaatgaaagagacgatggaggagtatcctatgattatcagccgttttgttttgcttctgggagccggaatgacgattcagggggcagtccattctatcggatcttcttttgacagagatcatcccaagtttgtttaccggcagtttcagcaggcagataaaaagatcgctctcggaatgtctcaggcgcaggctctcagagaacttggaagcagcattcagctgccatgctataagaaactgtcagtcctgctgtcccagagtctgctcagaggaacaagggatcttttaagcagacttgaagaggaagagacagaggcattttcagagcggaaggaaacggccaggcgcaaaggggaagaggccagcactaagctgctgatgccaatgatccttatgctcatcgttattcttaccctgcttatggtgcctgcatttttatcattttcatagaaaggagaatttattatgaaggagtttatgaaagatgagagcggcatgggtgtggtagaagtgattttgatcattgtcgtccttataggacttgtaattattttccaaacacagattaagagagtggtgcagaacatttttaagacgatcacatccaagacgggccaggttcaatgaaaacaaatacgaagggcagtgtgaccgtatatgcaagtcttatgtttctcatagtcttgctgctgctgagcatgtgtctggagggggcctatctctatctgggcaaagggaaggcccagggagcttatatggctgccctcgcaggtgccaggggaaattatcaaaaagagctggagcagcaatatcatctgtttggactggatgtgcggtatggaaaacagctggacgggaaacttgcggagacgttgaaatacaatctgacagagagcagagatccgttttctttttatcccggttctgtgaagacttctcataaagtttcgctggcagacaaaagaggtgagatcctgagagaacagataggagaattcatgaaatatgaactcggaaaagacggtatcaggctgctgaaagaaaatgtgttaaagatgccgggagaagaggacgcttcccgggtaagggaggtcatcaatgagtcggacagaaaagccaaagaagaggaagaagcggaggtgtcagaaaaaaagaaagaaaagccggtgaaagcaaaagatccaagaaaaggtctggtcaggattttgagggagggcatcgtgactgttgtcttgggaaaagaggccgaagtatccgagcaaaatgtaccgatcatctacggacacagggatacaaagaaagaaaagaatcctgatttttatcaggcggaatccgtaagtcagtctttaaaaggccggaggcaggatgcatcttcatctggcataaaagcagaacttatgggaacagcctacggggtaaaatatttcaggaactatacatccaaagaaaagaagaaggggctgcagtacgagacagaatacctgattgccggaaaggagtcggaaaaagaaaatctcggttcggtgttttccaagattctcttaatgagattcctgccaaatttgatttatgttcagggcgatactgtaaaacagggacaggcagaggcgcttgcggcctcaattcttggaattacgggaattgtacctgctgtcaagctggcaaagcatctgctgcttgcagcgctggcctatggagaatcaattcttgacctgaggaatctttcagaaggaaaacaggtgcctctgtggaaatccaaagacacatggcagatggaattcgcgggtctttcctcactcaccggcagaagaaagtctgtaaagaaaggactgtcttataaagattatcttcaggtattattattccttcagactgaaaaacaggaaaaatatctgcggatgatggatgtgatcgaggacaatataaagaggaaagtccgcgggttttctctgaaggattgttatgtttcctttgaggcagagacaatcatgagtctgcatccgttcagattcgggggagtcagactgccggtcacagggcggtatcaatggtcaatgatagaagtatcacaatattaatgtcgaaacgggaggaggggagcagagatgttcttggattgtaaaagaaaacatttctccaagccaacagccaacaatataaaaatatcaactgaatacagacgatccaaaaggacatctctgctctcctcctccggcggaagcatgacgctggaggccagccttctgattccggtttttatattcttattcctggcgctggcctcggtcggtgaaaccttatggattcacggacaggtatatcacggaattacagaggctgcaagggaggaagcggtatatgagtatatgctggtcaaaaagaacatcccttctttgagaaccgtgctgctgaaacagaagtttctttcagctgtggaccaaaagaagctgaatcattcctcccttgcgggaggtgtgcagggcgttttgtttacagggtcacggtttcaggaaaacctcgaagcctatgagatcagggcacgctatcggatcgtataccgtcttccgtttcttccgccgtttacaggaaactacgagcagaagatcagacaaaaagcgatgaccgggtatgcagagggacagaaaggagctgacggcggggaagtatatataacaccctatgagagtgtataccacaaagacataaattgtacgcatctttctctgtccattgtttctgattcggatgtgcagaaatatatagacggaaaaaccagataccgggaatgtgaacgctgcacaaaataccataaagggaagatatccatcttatttatcgcgaaagagggagatgcatatcacacggatttaggatgcagcggtttaaagagaacagtcagtaagaaaaagataagtgaggcagaggggatgaagccatgcgaaagatgcgggagatagatggatatatgacattggaggcaagcctgatcatacctgttctctgctttttacttgttcttctgttttcgtttttcttttatattatggatctgggtatcgtatcgggacttgtaaaagaggcagggctgcatacggaagataagaatcaggaaacaaatctgcggcgggatttggaaagaaggatcgtgctgggtaaggtgagctctgtcagcgtatctgagacaaaggaaaagagaaagatcaaagtacaggctgaaattggagtgccggcggcgggaagtgtggaaatttttggactgcggctgtttaagatcacggaacagcaggaatttatgcttccaaaagagacagaaaagatcaggaggtggagcttgattgaatgaacagtgggtccgggaaggatttgaacattattatgttgtgcctaaaacagacggagaagtatatgaagaacaagtccttctgtcacatatgatcacagggctccttccctgtgaactgcggagaacggaagatgaagaggcctattattttcatcttgtttcggctgatttatatattgaccagattggaaaactggatgccaggaattttttcatggatctgatcacggtgatagaaaaagcggaggagcacctgctgaatccggatcattttattttgacaccgaggcatgtgtatgttttcgacggaaagccggctctctgttatgtgccgggaaacggatcagacattacagagcagctcagagagtttgtacagtcctgtattgaccggctggattatagaaaccggagccaggtcacatttttttatgaactgcacaacaggctgagaaaatcccctgtgtcactggacgggctgaaacaatttataacccctgaaccggtaatgaatgagatggaacaggagcttccggggacaaaagaatttatgcaggaagaatcctttaagcgcaagagaaagaaaaacagcaggatgcaggtctgttcggctatgctgtatattccgcttctgttttctgccgcctattttgcggccagagcatggaatgagggaatgacctatccaaatctcagagggattgtgatcggaggattcctgattgcgctaaatacgggatgtctgtgggcgggagtaaaaaacagcagaaaaaccatagagaaaccggaaaaggctgaggagcagcctgcggatgagactgtactaatgtgtgatgaaaccgcgctcttagtctgggagaaagggcctgttttgagacttttgggagcggaacatacggaagtagaattaaacagcgctgagtttactgcagggaggcaggaagaaggggttgatctcttccttccccagcccggggtgagccggaggcactttcaaatagtgacagagggcgggggatacatactcagggatctgggatcgaaaaacggaacatttttaaatggtgaaaaagtgtggaaggaaacagaattaaagagcggagatataataaaagcaggtacagaagaatttgaatttatggtataattccaatagagttgaaaaggcttctattggaggaaatgtcatgtaccagagaatattaaatttactgaatatcagaggataccaaaaagaaatgactcctttgggcccgtgttatgtaaaagaagattggggaaggaaaaaaggagtatttattgcctatgaacacaaaccggacggaagcctttatactacagaggagaccggatcgctgaatgaggaactgaagcagtatattggaccgaaggcatcggttcttgtactgattctttcagaacagggcagatccacatggacggatcctgacagggcttttgaggaattatatgatcctgtctgtatgatcctttcagcctcagacagcaaagaccggtcatcggctccgccagaagagttccgcttcagaaaactgaaagattaccaggctacggctgttatactgacgatcaatattttcatgtatctgtggtctgctgccagcacagagatccttaattggggagcgctcacatggatgcatgcattcaaacagggggagctttaccgtttggttacgagcaacttcctgcacaatggatttgatcatctgtttaacaatatgatcgtctttgttttgattggcagcagactggaaccgatcttcggcagggccagatatgtagccttatatatgggagccgggctgtgcggaagtatcgtctccgctgtgtactatatgaatatgggagaaatggtggcatctgtcggtgcatcgggagctattttcggacttattggtgcaatgctttggatcttgattaaaaacaggggttatcaaaaagaattttacggaggaggagtcgcgcttatgatcgcgggaagcctgtatcatggcttttctaccatgggagttgacaatgcagcccatatcgggggctgcatcgggggatttcttttggctatcttgctgtatcggcaagacaggggaaaatgagggtgaaggtagtgccctgatttaaggccgaatccatgtggatagagatgtccagttccctggcaatttcactgactacggataggccgataccgtttcctttgggcacaaaagagacaccgcggtaaaaggcgcgggactgctgttcttttgtcatgccgattccggtgtcggaaagactgcagacaataaaatctccttcccggcttaaatggacagaaatcagaggctctcttgaggcctctttttttctgcagattgcgttgacaccattggaaattaagttgttgaagatttgaaggtatttagtcttggatcccttgacataatagggagaggaatcctctgtctggacagaaaagcggattttgcactcgttcagccttaaactccatgaacatctgatttcttccaggagtgcgtttaagtccacgggctccagtgtggctgaggcatcggataccggggaaagcatttggcggaccatgtcaaagacagaggagaaatcagctttcatgccggaccagtaaacgtcctgtgagagctccgggtgtgtctgctctatgtactgaatctgactgtaaattaaagtcagagagttttttaattcatgagaaaatgttgtcagtgtattttgattcttcatattcacgcttctttctatgtacaaatttcatgcaggggcaactataagtttatatgggagttcgtgtaaaaggcaacggaaaacaggggcaaaagttcgacgatttttttccttttccattttcagaggttatgatacaataaggaaatgatgcaggaggaaagaatatgtcatatatggctttataccgaaagttccggccgtcggcctttgatgaggtcaaggggcaggatcatatcgtcacgacgctgaagaaccagctggaagccgggcgtatcggccatgcctatctgttctgcggaaccaggggaaccggaaagacgtcggtcgcaaagctgctcgccaaagcagtgaactgtgagcacccggaggacggaaatccctgcggagtctgcgaaagctgcagggagattcaggaaggcagttctatgaacgttatggagattgacgcagcgtcaaacaacggtgtcgacaatatccgggatatcaaagaacaggtgcagtattctccggcttcaggaaaatataaagtgtttattatcgacgaggtgcatatgctttccatgggggcatttaatgccctgttaaagactttggaagagccgccggaatatgtgatctttattctggccaccacagaggtacacaagatacccataacgatcctttcccgatgccagagatatgattttcaccggatcacagcagatgttattgcggaccggctcatggaactgatgtcggaggaacacgtggaggcagaagaaaaggcgctgagatatgtagccagaatggcggacggttccatgcgcgatgctctgagtcttttggatcaatgcattgcattttatctcgggaaaaaactgacctatgaaaatgtgcttgaagtgttgggaaccgtggatatcagtgtctatgcaaggcttctggacagcatccttgcaaatgatgtgacggaggttatcgggatcgtcggaaaggttgtggagcagggaagagaactatcccagttcatcacggatttcatctggtatttgagaaatcttctgctggcaggcaagggtgatgcatccatggaagctctggaagtttctgcggagcagctcagtctgatgcaggaaaagacagcacaggtggaagaagagactgtgatccggtatatccgcatactgtcggatctgctgaatcagatccggttttccacatcgaaaagagtgctggcagaggtggcattgatcaagatgtgccggccgcagatggagacggatctgtccagtgtactggagcggatgcgtatgctggaggcttcgcttgaacagataaaaactcagggaattgccgcggtaccccagactgccgcagaagaacctgttcagaagcagaaggaaccggaaaagacaacggagcagatactggaagagaggcttccgaaagccagagcccgggaactcaaggagatcatcaagcactggaagcaggtgaagcttgcacagccgccgatgatcaggaatctcctttcgaagggaattctgactgcggatgaatcgacagaagttctgagacttatgttcaagccggaaggcagtatgaacatggggaaggattactttcagaggcatcccgagaagatagaggcactggaagaggaactggccgagagatcagggttccaggtaaagatagagatcggtgaactggaatctgagaaaaatgatgacaccattaatctggattgtattcacatggatgtgacaatagaagaataaaaagagttttatttcaggaggtatttaagatggcaaaaagaggcggatttccgggtatgggcggaaatatgaacaacttgatgaaacaggcgcagaagatgcagaagcagatggaagaaacaacaaaacaattagaagagactgaatatgaagccacagccggaggcggagttgtaaaggttgttgtttcaggcaaaaaagaagtggtatccgtaagtctggatgaggaagtagttgatccggatgatattgagatgctggaggacctgatcgttgcagccaccaatgaagcgctccgcaagatggaagaagattcacagagcaaaatggggaaaatcaccggaggtctcggaggaggcatgggaggcggatttcctttctaaggatggataacggatatggattattacagcagtcagatcacgaagttgattgaagaattgggaaagcttccgggaatcggccccaagtcggccggaaggcttgcctttcacattataaatatgccgctggaccaggtgaagcatttagctgagagcattctggatgcaaaggaaaatgtccactactgtaaagagtgctgtaccctgacggatcaggacatctgtccaatttgttccagcagcaagcgtgatcacagtaccattatggtggtggagagcaccagggatctgatggcctatgagaaaacaggaaaatacgagggcatttaccatgttctgcacggagcaatatctccgatgcttgggatcggaccttctgacatccggctgaaagagttgatggccagacttcagggtgatgtgaacgagctgatcattgctaccaactcaagcctggaaggagagaccacggcaatgtatataagcaaacttgtgaagccgacaggcatcaaagtcagcaaaattgccagcggagttccggtgggcggagatttggaatatattgatgaggttacccttcttcgggcactggaaggaagaactgaattatgaaatgaaaaagagcagccgggcaggctgctctttttctgtaagtaactttaaaactttaaaacaataaggagaggattttcatcctcaagaggggtaggatttgaaagtatttaaaaatgtttaactactttacatgttttattgtaacgaataattgtgaacaaatcgtgaagaaactgtggataaattgaaaaaaggcggttaaattatcagaatatttagaaataaataataagaaaacaaaaaacactgtatacataatgaaattgcttgacaatatagggtctgttttttataataataacataaagaggaacaaggaaacggatacctagaaagaatcgatgggaggcgatattgtttggatattatgtcgaaagacatagaagacattctatatacagagagtaataaatttcatacagtgagccttcagaatatagaataaatatgtccggtatagattttatacacaggtcggagagacaggacaggtagaacgtcatacgaagaatcagatgtatatagaagagaacggaagtaaaagaaatgaaagatcaagaagtttgatgtttgagtcgcagagactcagagttcggattgattgagagattgaaggggatacagaagttgtgtatggcatgtatgaaatagggcggatcgaagagaagcctccgatcaataacaattaaatagtctaaaaggtgagtcgcagagactcaccttttttagttaagcgaatattatagtaataatttcacacttcatttttggattcttgaaaaaggcctataaataagatacaatacttaccaaaggagatgaagatcatgaaaaaacaggattgtatattttgcaggataatcagcggagagattccgtcaacaaccatttatgaaaattcaaaatttaaggtaatcatggatatcgctccggccaacaaggggcatgtactcatattgccgaaagaacactatgataatatttacgatatagatacggccacagccggagaactgtttgaacttgcagctatgactgcgagggctttaaagtcagtacttgactgcgacggaatgaatattttacagaacaacggaacagtagctggtcagaccgtctttcattttcatatgcacatcatcccaagatacgagggcgataccgtaaatatcggatggaaagaactgagctatgaagacggagagatggaacagctcagggaagccatacggaaggaaatgtaagggcatgtcaaagatatcctggaaaccgggcaatatgatatatcccctgccggcggtgatggtaagctgcggtgcggagggagaatctgacaacatcattactgtggcatggacgggtacgatctgtacaaatccgccgatgacctatatttcactgagaccccagagacattcctatcatatgatcgaaaagagcggtgagtttgtcatcaacctgaccacggcagaacttgccaaagcgacagacttctgcggcgtgcgctccggaagggacctggataagtttaaagagacgggactcacgggggaacacggtacactatcccatgcgccgtatatcaaggagagtcctgtgaatattgaatgccgggtagaaaagatcactcctctgggctctcatcatatgtttacggccagagttgtaaacattctcgcagatgatacttatatggaagaaaacggacggtttgccctcgaaaagaccaatcccctaatctattcacacggaggatattttgagacgggcagacagatcggaagttttggatactccgtaaagaagaaaaaaaggaagaaaagaaatgacaagccaaaaaggaaataactatattttaattggaatgcccggggccggcaagagtaccatcggagttctgctcgccaaggcattgggagccgagtttattgatacggatctggtgatccagcagaagaccggaaagcttttgagagatatcataagccaggaaggaaacgaagcatttaaaaagattgaggaggaggtcaacgcatctgtcgaagccgaaaactctgtgatcgcaccggggggaagcgccatttacagcccgaaagcgatggaacattttagaaatattggtacagtcatctatctgaagcttgattatgaaacggttgccgaacgccttggcgaccttgcggcaaggggtgtggtgctggataacgggcagacactcagtgacttataccgggaaagaatacctctctatgaaaaatatgcagacatcacggtagatgccgatgatttaaagatcggggaagccttagaaaaagtgttggaaaacttaatgtagtgtgatatactgataaatatgcgagtaagcggcatggaacttttgggcttatgcaggctatgactgcctgtccaggggttgtgtttaaaaaaagatacgcttatttttcagaagaatggatagattattgatagagaatgaatgattcgattgattgaatagagttttatatagaggtgtatgatggaacaatatatcattaaaggcggaaacccactggtaggggaagttgtcatcggaggcgcaaagaatgctgcactgcccattttagcagcagcagttatgacagacggaacgtgtactattgagaatatgcccgatgtcagggatacaaatgttttgctccaggccatggaaggcattggagccacagtgaatagattaggaaaacatgaagtagttatcagcggaagcgggatgaatgcggactgcgatgtggataacgagtatatccggaagatcagggcttcttattatctgatcggggctcttcttgggaagtataaaagggccagagtagccctgccgggcggatgtgagatcggaagccgtccgatcgaccagcatatcaaaggatttaaggcgctgggagccaggattgagatagaaaacggcatgatcacagcgactgccgatgagctgatcggctgccacatttatatggatgtggtatctgtgggtgcgacgattaacgtcatgatggcagcggctttggcaaagggaaatacaaccattgaaaatgtggcaaaagagccgcatgtagttgacgtagccaattttctgaacagcatgggagccagcatacgcggagccggcactgatgtgattaagatcaaaggcgtagaaaagcttggaaattgtgaatactccattattccggaccagattgaggcggggacattcatgactgcggctgtagctacgaaaggtgatattacgattaaaaatgttattccaaagcatctggaagccatcagcgcgaagctggaggagatcggtgcgcaggtagacgagtttgacgacgcggtcagagttgtagcaacaaaaaggctcgattccacccagatcaaaactctcccgtatccgggatttccgacggatatgcagcctcagatggcagtgtcactggctctgtccaacggaacaagcatcgtttcagagagcatttttgaaaaccgtttccggtatgtggatgaactgacaaagatgggtgcccgtattcaggtagacggcagaacagccatcattaccggagtcaaattgtttaccggggcagatgtctcagcacctgaccttcgtgcaggggcggcgctggtcattgcaggccttgcggccgacggttatactacagtcagcgatatcggatatatctaccggggctatgaaggctttgaaaagaaaattcagaatcttggcggagatattcagctggtgaacagtgagaaagaaatcgcgagatttaagctgcgtattgtatagatattaagggggaattgccggtgcgacaatacctgaagaatgaagtttttaaaatatccaagtggatagagttttatttatctgcgctgattgccatagccgttatcggcggcgggatctggatgatcaaagatctgatcgctattttatcatctaatccggattccgatgctgtctatcagtttgtactcaatgcatttaatcttgtgatctgcgtggagttcattaagatgctttgcaggcatactgcgtcgacactggtagaagtactgatgtttgcgattgcaagacagatgatcgcgcagcataccagtccggtagaaaatctgctctgtattttttcaatcgcggtcctcttcattataagaaagtattttctggaccgttttgaggacattgacaagacagtatttctgccgaaccagaagattgccaaagtaaatgagctggtccatgtgaacattccggaggaatacaaaggagagtccataggagaagcagtacttaagggcattgatttggaaaatgaagaagtaaagtgcgggcattgttattattttccgggcggggcagtccgcgtatctaaagttgccgcagggcaggtgaaggaagtggaagtcatccgcagcaggaatgtaaatatcatgccgaatttatgattttagattgaagcaggtccgatcagttcgggcctttttcgatatatatagttgctgtacagcagagcgaaaggagcacataatggaaaaaatattatttacatcagaatccgtaactgaaggacatccggacaaagtctgtgaccagatttcagatgctattttagatgaactgttaaaacaagacccgatgagcagggtagcatgtgagacttgtaccacaacaggactcgttatggtcatgggcgagatcacaaccaatgcctatgtggatatccagaaaatcgtaaggcagactttgacggatatcggatatacgagagccaaatatggatttgacgcgagcacctgcggtgtcattacggccattgatgagcagtccaaagatattgcccttggtgtggacaaggccctggaggcaaaggaatctgatatgtctgatgaggaactggatgcgattggcgcaggtgaccagggcatgatgtttggctatgccacaaatgagacggatgagtatatgccgtatccgatttctcttgctcataagctgtccaagagacttacgcaggtgcgtaaggatggggttcttccttatctgagaccggacggcaagacgcaggtcagcgtggaatatgatgaaaacggcaagcctttccgtctggaagctgtagttctgtctgcacagcacgatccggaagtggatcaggagcagattcacgaagatgtgaagagagagatctttgataaggttctgccgaaagaaatggtggatgatcaaacaaaatttttcatcaatcccacaggacgttttgtcatcgggggaccgcagggtgatgcgggactcacgggaagaaaaattattgtggatacctacggcggatatgcacggcacggcggcggagctttttcaggcaaggactgtaccaaggtagaccgttcggctgcatacgctgcgcgttatgtggcaaagaatatcgtagcttccggactggctgataaatgtgagattcagctgtcctacgcgattggtgttgcacatccgacatccatcaatgtggatacgttcggcaccgggaaaatatccagcgaagaccttgtggaactgatcaggaaaaactttgatttaagaccggcaggcatcatcaggatgctggatctgagaagaccgatctaccgtcagacatcaaattatggtcatttcggaagaaatgatctggatctgccgtgggaacgcctggacaaagccgatatgctgagagaacaggccagataagaggatacaataatgtcatacgaccttgtgtttaaaaacggaaccatcgtagatgtaaaggcaaagacaagttacagggcagatctggctgtgtcagggggagtgatcgcggagatcggcggacttgacggagaaagagaagtggactgcagcggaaaggtgctctgtccgggattcatcgatgcccatgtccatattgagtccagcatggcatcaccggccgcgtttgcagaggcagtgctgccccacgggactacgacagtaatcgctgatccccatgagatggtcaatgtcaggggaaatgaagctatgaaatatcttctggatgtatcagaggatctgccggtttccgtctatgtgatgctgccgtcttccattccttccacaccatttgaaactaatggggcggatttcacgtctaaagatatggaggcgtggatcgaacatccaagagtgctcggcctaggtgaggttatgtgttatccggatgttcttgcagggagaaaggagattatggataagatcgctctctgcaggggaaaagtgatcgacggtcatgctcccggactctcgggaaccgacttgcatcgatatatacaggcaggggtcatgacggaccatgagtgtacctcctttgaagaggcagaagaaaagcggagagccggaatgaaaattctcatccgggaaggaagtgcggcaagaaatgtggaggcaatcgtttcaggaatcgtgaagaaaggcctggacacggaaggatttcttttctgtacagatgataaacatctggatacgatcgagcacgaaggtcatatcagctataatataaagaaaagcatccggctgggacttaagccggaggaagcagtggccatgggcacttggaatacggcgcagacatatggtcttgccggcgtcggatgcctggaaaagggatttgatgcagatatcgcagtcttagattctttggagaatatgaaagtgctcgaagtgtacaaaaagggtatcccgtccgggcgtctgctgaaagacagggcggaacatgaatcggattacaggggaatgatgcacacagtgaatctgaaaccgttcactgaggaacagctgaaactgcacacaaaaggaaaagtgccggtaatcggactggtgcccggacagattacgacaaggtacctaaaagaagaggtggctgctgagaacggtcttttttgtcccgattccacatattcaaagctgtgtgtgtttgagcggcacagaggtacagggaatattaaggcagctccgctgaagggatatgggatcactaatggagcagttgccacatcggttgcccatgactcacacaatattattgcagcaggagataatgacagagacattatgaaagctgtggagatgatacaagagatgcagggaggctatgctctggtgcaggacggaaaagatgtggggagacttccccttccgattgccggactcatgagtacgcagcctgcaaaggagatacagaggcgtttggatgccatggtacagagagccagggaaatgggagtatcagaggactgtgatcctttcacaacattgtcatttatggcgctcccggtgataccggaactgcgcctgacagataaaggattagtggatgtaaaaaactttcagatgataaaggaaaaaggtgagtagaatgagcagaagaaggaaaacaagaaggaaatggaacaaagccggtattgccggatggattcttttactggctgtagtcatagccgggggtatctggtttgtccgttccggaaagacaaaatacacaagtgtaaatgacgggatcggagagatgactgcaaaggccaacgaaggcgtcatggacaaaggaacaggggatgaattaaaggattcactttatgtgccgagaaaaattgataagacgaagaagctgatcgcattttcttttgatgacggtccggccagagagaatacggacagaatcgtcaaggctttagataaaaatgacgcgagagcaacattttttatgctgggacagaatgccaacctgtatccggaattggtaaaggaagtcatggattcaggaaatgaagtggcaggacattcatggaatcatcctcagctcacaaaaatcggggcttccggagtccagctgcagatgcagaagatgaacgctgccatctccaaggtgacaggagcagatgtgggacagcttagacctccttacggtgccatcaatgacacagtaaaagccaatgttgatgcgcctctgattttatggagcatcgatacactggattggaagacactgaatacaaatgccacggtcaatacgattttaaagcaggcaaaggacggagacatcgtattgatgcatgatatccataaaccttcggtggcagcagtggaaaaggttcttcctcagctgaaagcaaaaggatttgaagtgtgcacggtatctgaactgctggaagccaagggtataaaggtaggcaagggcgatgtggtcataagtgcaaaccagatcaacaggtataaaaaataggttacataggatcagtgattcactcacccgggtgagtgattgactgcagaactattgcttgagcagcagaaaatttttataatagacctatcacaaaagacaggtgtaggttgtaagattaaggcaggaccttctttatggttttgcctttttcattgatccgaaataataaaaggaggcaaatgtatgaaaaaagcagtaatttcagtgggccacagtattttgaaaaacggtatgtgcacttcagccagcggtgttgtgaatgaataccagtataacaaggcgcttgcccctcttttaaaggtgtacctggagaagaacgggtggaaagcagatgttgttgtatgtcccgaaaagaaatttgcatctaaggaagaggaaaaatcatataaactacctctcatcaatcagggcgtctatgatctggctttggaactgcatttaaatgccagcgacggaacaggacatggcgcggaagtgtactacaagacggagacaggaaaagcgtatgcacagagagttcagaaaaagctggccggtgtattcagggacaggggagcgaaaaaagaggatcatctgtattttctaattggaacaaaaccggcagctattcttgtggaaagttttttctgcgataataagggtgactgtgaattgggaaaagatatgaaaaaggtagcaaaattgatagcagacggaattgcaggaaaatagtctgtgaggcagttctctttttcgtgcacagattgagaggaatattttttcatatggctgtattcttttgttgtaggagggagtttagagatggaatggatgaagcggctgaatcaggccgtatcgtatattgaggaacatctgacagaggaaatcgattatgaggaacttgcaaagattgcatgctgttccacttatcattttcagagaatgttttcttatattgcagatgtgacgctgtcggaatatatccgccgcagacgaatgtctatggcagcggctgagctgagcaccggaaaggaaaagatcgtggatatagcacttaaatatggctatgattcaccgaccgcatttaaccgggcatttcaaagtgttcatcacacagcgccttcggcggcgagaaaaaacggtatcatattgaaatcctatcctcccatcagttttcagatcacaataaaaggagatgcagagatgaattacagaattgagacaaaagagagcttccgtattatagggccgtctgcgccgatgcacaaagatgtggaaaaaaactttcagatggtacccggactgtggacaaaagctgccgcagacggatctgtccagaaactggtttctaagattggaaaagaacctcagggcattttgggagtcagtgcatgtgacgataagtcagagcagtggaaatatctcatcgcagtttcaagcgatgatcccgcagaagaaggctgggatgaatatatggttccggctgccacctgggcaatctttgaaggagaaggtaccatgccggaatcgattcagcagctggaaaagaggatcgggacggaatggctgccgaactcaggatatgagtttggggaagcgccggacattgaggtatacttgaatgcggaccctgaaaatgcaaaatatgaagtttgggttccggtaaagaagaaaagtgaataaacggtaaatcaaagatccggcagctgtaataactgccggatctgcatttttacagatcatccactaaggcactgctttttgcatacgcagtgctttttgcctcgaaaaaatctgttttaatcatgttggcattagagaactggctgacccaggacatggattccggttcagtttcactgcctggatagatgggttcaaaaccgagattttggcacctcagatttccaagataacggatatattcctccaccatttcttttttgagaccctggatctcatcgccgatcacataatgaccccagcggatttcctgctcacagccctttttaatcatccggcggtagtcattgatacagtcaggatggaacagggagggttcttccttctttaattccagcagaatatttttgaacagccacaaatgtgtattttcatccctgttgatataccggatttcctgtacagaaccaggcatacggtgatttcttccaagattataaaaaaacataaaaccgctgtaaaagtaaatgccttctaagatgtagttggcaacgagtgtttttacgaatgtttctgtatttttattagtctgaaaatcattataaaggtctccgatgaattgatttctctccagcagatgagggtcattcttccactgatacaggatatcgtttctttcctggggctcacagatcgtatccagcatatagctgtaactctgactgtggactgcctcctggaatgcctggatcgacaggcacagattgacttcattggctgtgatatattcactgatatttggaaggtttgccgtctgaatgctgtccaggaagataagaaaagaaaggatcttatcatatgcccggcgttcaggctcggaaagctgcttataatctttgatgtccgtccccagattgatctcttcaggtatccagaaattattcatagcctggcggtaccagccgctgacccaggggtatttcatattgttaaaatcattcaggttcgttgtatttccgttgatcatcctgcgctttcggacatccgtgtcaccgtaaggattaaataaaggtttttttgtaagttctgtcatcgtttctctctctttctgtattatgaagaacaaacttcgcagtcttcaacttcaagacttttggaccgcgtgtaataaattgttttgactccctgttcccatgccagaatatagaggtccaggacttttcggaacgtgtattcattggtgatatacagattcatgctctgtgcctggtcgatgtgtctctgacggacaccgcatgctttcacagaccaggtctggtcaatatagtgggcatttttatagtaccagaatgtctccatggacagttcaggggcaactcttgggatcaggccgtattttttttcttcaagaaagtagcggttcatgacagggtccagacctgccgtggtgccggcgatgatgcttgtactgctggtaggtgccgcggcaagcagatagccgttgcgcaggccgtgttttttgacccggtcttcaagtgctttccagcgtcctttcgtgagatcccgctttctgaaataatccccggtctgccagtcactgcctgggaaatacggataagatcctttttcttcggaaatttttgagctggctgccagtgcggcataatggatatcggaaaatactttttcagcaaattttaaatgttcttcgctctcccattgtattttatgctttgccagcatgtggtgatatccgctgaccccgagtcccacggggcggtatcttttgctgttgatctcggcataaggtacgggaaaaaagttcaggtcgatcacattgtccagggctcttaccgcactctctgtgacgtaggacagctgttcataatcagtgacacacagattcccgagggagaggcttgcaagattgcagacgacaaagtctcccggttttgtgacagtgacaacgacttcttcaccgctgatcatttcaattttctgttctgtctgccctgaggcactcatgttctgggcgatctcggtacagaggttgctgcagtagatgattcctttatgccggttgggatttgcgcggttgacatgatcccggttgaacgtaaaaggcgttccagtctctgctgcacttttgatgatcatccgtacaatatctttgatagggatcacacgcttactgattctttcatcaaggacacagtccagatatttttcggtccactctgttccatagcagtcctccagtgcatagcctttgactgtgagtatctcatgggggcacatcaggtaccagttgccttcaatattgtctcttgcctgttcccagaaatagtcgggatagcagacggcagggaacacatcgtgggctttcatccgctcatctccgttgtttgtccggagactaagaaattcgggaaggtctctgtgccagacgtccaggtaaacggccacggcaccctgccgcattccaagctggtctacggccacagccgtatcatttgcgagccgtatccagcggattacacctcctgcggctccctcaaatccacggattgaacttccgctggccctgacttttccaaagtaaaggcccatgcctcctccgaatttgctgaccttggcaaagctgtcgatactccggtagattccgtccaggctgtccggaaccgtgtcgatgaaacaggaagagagctgatgataaggtttcctggcattagaaagagtcggagtggccatagtgacctggaggaggcttaacatatcataaaatcgtttgacccattgatttctgtcttctgtttccttcattgccagatgcatggcgatgcccatgaacatctcctggggagtctccagaggattcccctgccggtcccggattacataccggctgagcagaagctccagaccggaataatgaaacaggctgtttcgttccggccggatccaggatgagaataaatgaatctcatcttcagcgtaatttttcaggatataatctccatataaattctgctgactcaaaaagacaattttttcatagaaattccggatctgatattcttctaagttgtttttaaccacagattcgaactccaggattttgagtcttgcggcaatattctcccatttgggagcctcctgggaagtgagttcggcggctgctttaacaagcagaaggagtttttcatgatcctccataccttcctttagaaaactctgaaacttctcattcaggatgtttaagctatattcctcctgtagaaattcattctgtatggatttgagcaggtctccgatcggaaatttctctgtccggaatgactcaagtattgcctgccgtacgacgacagcgtattcggaaccctgtgctgttgttatgtttttcataaaaatgttcacctttcaactatatgtaggatgctaaaaattatattagcacaatatattgatcttgacaacgtatatcaagaataaaactgatccaaaaagacacggaaatctattcctcctgggaaatttcacaggaattgtgcagcttcattgtttgatagcccctctccctaaagcctttgtatatattgattacattttcaaggtctgttaggatgaatttgttgaaaataacaacacagtaaagaccataaaattccgtctgatgtgttgtgctcaatacccaggcgccgggctttgagtccagttgacaaagaaaggatgaaaaattatgatgcagaaaattcaaaaattcggcggggcgatgtttacaccggttctcttgttcgctttcgcgggaattgtcatagggatcggaaccctgtttaccacagagactattatgggcagtcttgccgctccgtccagcatgtggtacaaatgctggaatgtgctcttacagggcggctggaccgtatttaaccagctccctctcctgtttgttgtcggacttccgattggcatggcgaaaaaacagaatgcccggtgctgtatggaagctttggttctatatctcacattccattatttcctcagcacgatcctttcccagtggggaggagtcttcggagttgactttgcacaggaagtcggcggtacaagcggtctcacgatgatcgcaaatataaaaaccctggatatgggcatgatgggagcactcgctattgcgggaatcgtcatttacttacataaccgtttctttgacacggaacttccggaatggctgggcacgttcagcggctctactttcgtattcatggtcggattttttgtgatgattcctgtggcagtcctcgcagcattattatggccgaaaatccagcttggtatgtttgcattccagggatttgtcaaaggagcgggagctctcggaatatgggttttcgtctttttagagagagccctgattccttttggcctgcaccatatcttatattcacctttttattacgacaatgtggtggtaccaggcggactttatgcctactgggcaaccaagcttcctgagatcgcagcatccagtgcgtctttaaaatcgctggttcctatggcaggattcacatctacagggttttccaagatcttcggatgtccgggaatcgcacttgctttctactcaactgcgaagaaagagaagaaaaagaagatcttaggtctgctgattccgattactctgaccgcgatattctgcggtgtgacagagccgatcgagttcaccttcctgtttgtggcgcctgtactctttgtagtacacgcactgctggcggcaaccttatcgactacgatgtatttggcaggaatcgtaggaattcactccggaggagcgatcgaaatggcttctttaaattggataccgctgatgggaaatcactggaaacagtatctgctcctgctggtcatcggtcttgcatttaccggaatttattttgtggtatttaaattcctgatccagaaatttgactttaagacaccgggacgggaagatgatgatgagattaaatttggttccaaggaagaattcagagagaagaaaggttctaagcaggaccagaaaatcgagtttgcgcagctgattctcgaaggactgggaggaaaggacaacattgaagatgtgaccaactgtgccaccaggctcagggtcaacgtaaaggatgagactctttgtaaagatgacccgtattttaaatccataggagcccatggctgctctgtgaatggaaaatcatttcaggttattatcggcctgaaagtagcaggcgtccgggatgattttgaaagtttactgtaatatattgagttaagaaagcagggatgaagatgatgaatgtaaaaagcagcagattagacaggtattacaatatcgccaaggtcctcctttgcctgacgccgtttgtgtgtcttgcatacctttccatgggggcggccagagtgggaggctcagtctcagccgcgatcggggaagacccgaagcttgcggtgatgttcctggtgtctatgatcaatccgtttatcgcatacctcatgacgtttatgcagaagaaattacacatggatgctgcctatgcagctgtcaatctcaccctgctcattgcagctgaaatcatgcttcagaatgtatggtatatcctgctccttggatttatattgtataagactttacgggagtatggactgaccatcagggaaagttttaggaaggaatggagagaaaactttctgagtatcatctcggggagccttgtagttataggactttgctctgtttgtctcttcgccaccataagaatttccctgcactgaacaggaaaagccgcagaacttctctaatctgcggcttgcctttattatgatgaaatatctgtttacatatctccaatagagaaattcaccagacgaaagtagtcttttacattctgaatcttcaggccaaggtataaacgtcccccattctctcggtgctcttgatacaaattcttttgaacactgcagctgtttctgatatccacagacttcccgccttcagacaaaagattcacagggccgctgcaccggtctgcaaggtataaaaattcttccagattgaaaatataaagttttatcattgtatctgtcctccttccataagatcaaagtttttaggagagacagaatcagggccctgtttctgttctgcttatctgttaatataataataacgaaaaaatatagataaaaatataagattactgctgttttatatcaggattctgccatttgcagcggtattccctgggcgtgcaccccatgacttcccgaaaagtttttccaaagtagctgctgcttccgaggccgcaggactggccgatataagaaacagacagactgggatcagagagcatgatacaggcttgccggattcggaagttttttacgtattctgaaggagttatgccaaggctctgccgaaatatacggaaacattcccgctcactgatataggcggcaagtgcgatccggggcacagtaagcttctcagaataatgatcctgaatatattccatcattgactttatcttttggtccgaaccgctttgcggtttcttttggcctaaaagaggccgggataaagagagcataagacaccagagtttagagagagccgaccggagcagtatttcatatccaaattcgtggggagataagaaaaaggaatcccggagcagcttaagaagcctcttttcttttggagtccggggataaaagctgagtatttccgcctgcggggaaccggtgaacggaagaatatacttttgatccagcaggctgccgtgttgtccgctgatcagtgaggaatcaaagatatgatccagctggatcgtatctttttttggatccaaagactttgtggaatgcagaatattggagttgaccatgccgccggaaccttccgggaagactatttttccccctggagtgtcatactccagagttcctttttcaatgtaaaataattcgatctctttatgccaatgccacggtatctgtccgccgatgcaccggtcaaactctacataggaacaggtatatggaaaatccggaccaaaatcggggaacagttcttctttggaattgtttttatactggattccatgcacatgattcataggttcaccgcctttctctattactatattaatacagctttctaaagaacgcaaatctctgaaaaacaaggaaatatcccgttttcagaggctgtgaaaattcacagcttttgttctgtgtcacggaaccaatgaccactccctaaaccctgaaaatctattgtcaccggatgcttttggggtgtactatttggtcagcgaagaaaacaacaaagcaaatagctaggaggatgttgattatggcaaagaaaaaatatgcagttacagtggcaggcgggggcagcacatttacaccgggaatcgcgctgatgctcttagagcacatggaccgcttcccgatcagaaagattatgttttacgacaatgacgccgagagacaggaagtagtggcaaaggcatgtgagatttatctgaaagagcacgcgccggaaatcgaattcggatatacgacagatccggaaactgcgtttacagatattgattttgtcctggcacatatccgtgtaggaaaatatgcgatgagagaattagatgagaagattccgttaaaatatggagtgctcggacaggaaacatgcggaccgggaggaattgcctacggaatgcgttccatcggcggcgttatcgaaattttagattacatggaacagtattctccgaatgcctggatgctgaactactccaatccggctgccatcgttgcggaggcgaccagaaggctgcgtcccgactcaaagatcctgaacatctgcgacatgccgatcgacctcgaagagaaaatggcagatatgtgcgggctgtcttccagaaaagaaatgcaggtcggatattatgggctgaatcatttcggatggtggcataaaatttatgacaataacggaaatgatttgatgccgcagattaaagagcatatgaaagcaaacggttttgcagatgcactgtccgatacaaaccagcatgtggatgaaagctgggtacatactttccaaaaggcaagagatgtctacgcagtcgatccggaaacgatcccgaatacctacttaaaatattatcttttccctgattatgtagtagagacatctgatccggattacacaagggccaatgaagtcatggacggacgggagaaatttgtgtttggagaatgcaggcggattgtagaaaacggcacaagcaaaggatgtgcgtttgaggcggatgcgcatgcaacttatatcgttgaccttgcctgtgccatcgctgagaatacacaggaaagattccttctgatcgttccgaatgaaggggcagtggaaaactttgaccgcacagccatggttgagattccgtgtatcgtgggctgcaacggttatgaaaagatctgccagggagcgattcctcagttccagaaaggattgatggaacagcaggtgagtgtagaaaaactgacagtggaagcgtggatcgagggaagctatcagaaattgtggcaggcgcttactctttcaaagacagttccgagtgcaagagttgcaaaactgatcttggatgatctgattgaagcaaacaaagacttctggccggaactgagataagtcaaatgggaggtatgggatgttcggatttttaaagggaaaaagtaaaaaagagaaggtattttattccatggtaaccggaaagagtattgacctttctgaggtagacgatgaaatgtttgcaggaagggttctgggtgacggaatcgctgtctggccggaggaggatgtgttttcagctccctgcaccggtacagtgactacggtgacggatacaaagcatgctatcggacttgagaacggtgacggtgttcaggtgctcattcatatcggtctggacacggtaaaacttgatggaaagggctttgaaacttatgtggagccggggcagaaggtaaaagccggtgatccccttgtaaaggtggaccgtcagatgctcagggaagaaaaaattccggatgtctccatgctggttttcatagaaccaaacggacataagctgactaaattttatacaggacagacagtgaaagcgggaacaagtcctctggtggaatacgagtaggaaatttctccattatcgaaaggcaggtatcatgaggatatctgcctttctgcatcaatggacaaaatgtggaaaatagagtaaaattggggtaagattcaggaaccaaaaggcggcggacacatttatgaggtagatgtctttatgaaattagatgaactggtgaacaagcattacggacagcttaacgagaatgatttatacatatggaattacatatcttcgcacaggaaagagtgtgaaaagcttgccatagaccagctggcatttaagtgcagtgtgtcgaggacaaccgttctgcggtttgcccagaagctgtccttaaaaggttatggtgaactaaaggtctttttaaagcttgataatcaggaggcaaaggaaaacatcgggcatgtggacatggtctgtgagtcataccgccgggtgatcggcagcatgaaagaaaaggactgtacagatatctttaggaagtttgatcaggcaaagaatatctacgtgtatgggatcggcatgatccagtcttccattaaaaaagagttaaagcggaccttcatgatgagcgggaggctgatctatgatctgagcggatatgaggaagcggaaaggcttctcagcattgttacggaggatgacttgtttatcatcatatctgtttcaggagagaatgaatttatcaacaatttcactaaaaatctaaagatccggggcgtctctgtgctgtccatcacgaagcttcgggaaaacacattggcacatatggcagattatgctctctatgttaccgagacagtgttttcccagccgttcagtcacatagagtatgattctctcacatcatatttcattttgattgagattttatttttaaagtacatggagtataagacaaaaaaagaggagatagcggatgaggctggaaaccctgattgaagaaaattatgataaactgaatgaaaatgatttgagcatctggaactttattctgcggcacaagaaggagtgtcagactatgtcgatccaggagctggcaaaacagtgccatgtgtcacacacaaccgtctcaaggtttactcataagctggggatggaagggtacggggaactgaagatttttctgaaatgggacagccgggaggaggaatccttcgatgtaagggagatcgagcgggtctaccaggattacataaagactctggatatgatgaaggacagggactgttcggatgtctcagagatgctctccagggccggaagcatatatgtatacggaacaggagcggtccagaaaaatgccgcgagagagttaaaaaagaacctgctttttctggactatctttgtaatctgatcgaaggccgggaagaaataaagatggtgctggaaatcgtaaaagagggagacgtattttttctgttttctctttccggtgaaaatgcctttgtcaatgaacttgcaggcaggctgaaggcaaagggtgtcaaaatcatctctgtgacaaaagtggggaataatgaattgtcgaggctcagtgatatcagccttcagttttatgctcatccggtgctgaagggaaggtttaattccgatgtatatatgacagctcagttttttgtgatcaatgagttcttacttttaaagggattggagtatggaacaagcgaagagtgattaatgtagatttattttgttttgatatatgcgtgtcatagggttaataaagggagttttataacctccgataagagaaaaataaccaatatcctttagtatttgaagagctttctcacggtcagtaattattaactttttttcgttggtaagtttgtaaagttgagaattatatgttagaaaaggttttgtcaatttacatatctcctgtaaaagaaatgtttgaagaaaaaggagggccctcaggtcctcccccggtttcagtcctctcgagtatctgaaacctgatccctgaaattagtttaacataatattgtttataagtaaataaattacatattcttcaagacactttttaaaaataatcataagtaatcttaacttgctttatgtaaagagtgaatttaaaaggtacaatagacggtctctctcttttctgttaaaatataaagaaaaatcaggtggtgacagatcatgtttgtagaggaaagacagcaaaagattcttgaacttttgcaagaaaaccagaaagtaagagtgaaagagctgagccggatgtttgaggttacagaggactgtatccggaaagatctggccagtatggaaggacgcggtcttttaaagcgtgcctatggaggcgccgttctgacggaaggcatgcaccccgggcacagcaacgcggtttcttccaggaaagaaaaaaacctgaaagaaaagcagagaattgcaaaaaaagcggtaaagctgatcagtgacggggatgtggtttttttggatacatctacaacgaatctggaggttgcgagggaaatcatccgttctaaacgaaacgtgacggtcgtaagctgtatgctggatatcgcaaatttgttcgcagcggatggaaacaccggatttattcttttgggaggagagttcaatcggtctcaaattgggtttctgggttcgctgaccctctctatgatggagaacttcaggtttgacctctgctttatgggagtcgtcggagcggacgtaaaaggaaatgtggtcacgacttatgttccggaggacggagctatgaaacaaaaagccatcagtaaaagccgcagaagatatctggtcatggagacaaaaaagtttgatttccaggcaaattatgtctttacagattttacacaggtggatgggataatctgtgagaaggagcctcaggaagagataagagaagtgctgagagaatatggaacagagatcatagcatgacagttcctgtatgatctctgctcgatttttgaaatgtatggatagcaatacaaggttaaaattatttttggatttgtatcattctgtccacccagccgcagtaaaaattctcttcatgagatacaaccagtacggttcctgtaaaatctttcaatgcatttttcaatgcttctttagccgctgcatccaggtgatttgtgggttcatccataattaaaaagttacatggttttagtgtcagcaggcataactttaccttacactgttcacctccgctcaatgatcctatctcctgtccggcatgacagctggaaattccgcactgcgcaagatgctgccgtacttttttgattgggagagagggataacagtcagacacgatctgtagcggtgtcctggttgtatcatcccatatcagatcctgttcaaagtatccgatggtgacctgttctgaaaatgagaaactgccgtctaaggcaggaatctgattcgtcagagttttcaaaagggtggatttgccgattccgttgaaacctgtgatcacaattttctgtcctccttttgctgaaaattgaaggccggagagaagcggatattgataccccacagacaaatgtctcacggacaggtggtcagcatttgtcaccggaagctgtgaaaaattaaaacacggtcggttctcagttacgtctggattttccatgcgttccatcctgttcagctgcttcttgcgtcctctggccatttttgactttcgcccggccatgttttttctgataaattcttctgtttctttaatctttttctgctggaaagaataccgtcggatatattcttcctgaagaaacgttttcttttttaaaaaatcagagtaggtgccgtaatattttgtaagtctgccgttatgaatatcgcatacgcggttgacactctgttctaaaaattcattgtcgtgggagacaaccagaaaagcgctcggaagccctgaaaggtagtctgccagccaggagacgtgctccttatccagaaagtttgtaggttcatccagcagcaggacagaaggctgttccagcaaaagtttagcgaggatgactctggctctctgacctccgctgattttttctaccgggcattcaagaccgatagtgaggagtcccagtccggcagctgcctgttcaatcctggtgtcaatctgataaaagtcatggagctctaattgttcctggagccgtgcggcggcagggagggctttttcatctccggccgctgcttttgaatacagcagattcatttgctcctcttttataaagagagactgaaaagcagattttaagaaatctgagatcgttatattttctttcatctgtgcgtattgatccagacatccgaaagaagctgcaggatgtctgaagatctgtccgctgtcgggagtaatctgtccggtgcagattttgataaacgtactttttcctgcaccatttggaccgacaattcctatatgttctcctttattgagctggaattctgtttctttaaaaagctgtttatcaccgaatgaatgtgataaatctttaatatctaataaactcatgatgatctgatcctttcatataaaaaagacagaagacaaaatacatttctgtatctgccttctgccgtattgtcagtgtgttataaaacaacaaaaggccgcggacaaaacattgtccgcagccttttagcatgggattcttcgggaaaacaggtatccaaataaggactgctcatgcagccgcagatgattctggatctgtctcccgatgaaatcttaaagcggataaaatccgccgtactctgcacaatgtttcatcggtctgaattgtacagagtttactcgccttctcggctggtctgatctatataagcccatgctggctgctccttttgtttcataaaattttctgagtgggttttgagatttcattttgcacacgcttgtagtgaggcaattcaaagccgaacagaaatcgtgtgcaaaatgccctacattccctcgtggaacgttcttcttacaacttcttcctgctgttctctggaaagcttattaaagtttaccgcatatccggaaacacggatcgtcagtgtcggatacttgtccggatgttccattgcgtcaatcaatgtctcacggttgaatacgttgacattcaggtgatgagcgccctgcacaaagtaaccgtccagaatgtttgcaagattttcttctctctggtcctgatctttacctaaagcttcgggcacgatagagaaggtgttggaaacaccgtcctggcacacgtcgcggtaaggaatcttggctacggaattcagagaggctaaagcgccgctgttgtcccgtccgtgcattgggtttgcaccaggagcaagaggctcccctaattttcttccgtccggcgtggagcccgttttctttccatacataacattggatgtgatggtgagtgcagataatgtatggatggcatttctgtagatcggatgtttctttaattcctcagagaataaagtgacagtgttgacagccaggtcgtctgcccggtcatcgtcattgccgtatttcgggaaatctccttcagtctcaaaatctacagccacaccgttttcgttgcgcaccggttttacagtggcatatttgattgctgataacgagtctgccgcgatggaaagacctgccacgccgtatgctgcgatacgctccatattggtatcgtgcagtgcaaactggctcgcctcgtaggcatatttgtcatgcatataatgaatgatatttacggtatcaacgtataattctgctacataagcgagaacttttttgtagttagcccaaactttttcgtagtccaatacttcatcggtgatcggctcgatacccggaatgacttcaatcccctttttctcatcgatgccgccgttgatagcatacagcagggacttggcaaggttgcagcgggctccgaacagctgggtctgctttccgactttcatggcagacacacagcaggcaatggcataatcatctccgtagatcggtctcatgacatcgtcattttcatactggatcgaatctgtgtcaatggaaactttggagcagaacttcttgaagttggccggaagcttttcagaccaaagcacggtcaggttcggctccggagctgttcccaaattatacagtgtatggagataacggaaggaggtctttgtcacaagcggtttgctgttgattccgataccgccgatggactctgtgatccaggtaggatctcccccgaataattcatcgtactccggtgtccttaaatgtctcacgagacggagtttgataataaactggtcgatcagttcctgagcgtctttctctgtcagcacgccgttttccagatcacgctgaatataaatatcaaggaaagtggaagtacgtccaagggatgtagccgcaccgttgttttcttttacaccggcaagataagccatatagaccgcctggaccgcctctttggcattggatgcaggtttagagatgtccactccgtaggaagcagccatttctttgattgctcctaaagcacggatctgctcggagacttcttctcttgcacggatgcgctcttcgctcatcggtccgtctaaggcatccagatcgcgtttcttttcttccacgagataatcgatgccgtagagggcagcacggcggtagtcaccgatcacacgtcctcgtccataggcatccggaagccctgtcagaagaccggctgtccttgcaagccttgtgcgctgcggataggcatcaaagacaccttcgttgtgtgtcttgcggtattcattgaagtgacggtctatttccggattcagtttgtatccgtactgttccagagaagaatgggccattctcttgccgccgtataagtttacgatgcgctttaaaggagcatctgtctgaagacctacaatgatttcattttctttgtcgatatatccgggtgcaaagttagtgatgccggaaataatattggtctctacatccaaaacaccgcctttttttgtctcttcagaaagcagttcttcgcatttgttccacactttttctgttttttctgaaacacctgccaggaaagagtcatctccttcatataatgtataattcttctggataaagtctcttacgttggtttcctttgtccattttccttctttaaagccgttccattcttttaacattgttttcctccatattgatcaaaataggttttctgaagttgtttggtgcgttccttgtccattgccggaactcctttgagcgggtaagaaagattcattacctcatatttgttggtgccgagcagatgataggggagaagctctaccttttctacgttcggtatgcggtctatgtattcttttaattcctgcatgtgctctttgctgtctgtaagtcccggaactacgacatggcgtatccatagtttcgtgccgtttcgttccaatgcctttagaaattcgatgaaccgctccataggccttcctgtcatagactcgtaagccggcccggttatttccttgagatctaaaagtaccagatctgtgtatgaaagaatttcatcgtaatctccctgaccaaagcctgcggtatcaatgcacgtatggatgccttcctgtttacagagtttcagagtcttaagcaaaaactctggctgcatcaggggctctccccccgaaaaggtcactccgccgttctgtttaaagtagggcttgaagcgggaaatccttttcaccagcgcctccggagtcatctcttcgccgccctgaaattcccaggtgtcagggttatggcagaatttacaccgaagggcacagccctggaaaaaaactacgctgcggatgcccgggccgtcgactaatcccatggattccatggaatggatgtgtccaacaatcataggaacctcctgtaaaaatgttgattggctgcctgggatacgagtatcagcggctcgtggaaagccgtagactttcctaatggaataaaaaaagccgcacgtccaggcagggtgcccagacggtcggctaaaaattcgttgtcatacttcctgtggtaaactccacttgtccgtcagtcatatgacttatgactttaaaatactatacatcgcaccgcaatgtcaaccccgtaattgaaatattgtttgtgaaatttttagccggtttcatcgtaacgtgaggtttcctgcttgtctaccgggtatgtgataaaagttttcatgtttaaaattcagaaaatccgggcatgttcatagtatgaagaaaaaatcaatcatctggatgtttttccttgccgccgcggtaatcttttctgtggtatgggcaaaagagaaagacggcagagcggatcagaaaataaaacagggagtcgtgcggttccacatacgggcaaacagtgacagcaggaaagaccaggcagaaaaactcctggtcagggaccaggtagtggcatatctgaagccgtatatggaacaggccaacacaaaagaagatgcaaagagaattcttaacagccggaaaaaggagattgccaaagtggcaaagtccacgctgcaaaagaggggaaaggatctgccggtcaaagtctatctgaccagagagaagtttcccgaaaaggactatggcagctatgtgtttcccgagggaacctacgatgcgctgagaatcgatctcggaaatgccagtggacataactggtggtgtgtcatgtttccggacctttgcattacgaaagaaagcgaagcggcaaaagacaaaaagaccagaaaaaaactggagcagcaggtaggaaaaaaaggagtggagaagctggaaaagaagaaagagaagctgccctggtttttgaaatggctggagtaatcaggtaatatttactaaaaatcagacataaaaattaactaatttattcgttgaaatttgttgcaaaagagggtataataaagttacaaaagttttaaaaatttataacagtacaatttatttccaacacggctgagacgggcagaaagtgaaggagatggtatggatgaaaaagatttcaaagaggcatacggtctgggagattaattatttttataggtctctgctgctcataacagcagggattctgatgattttggtcttcctgctgctcctccggtaactgcagacgattacatatcaataaagagggaattttacaggataattctgtgaaattccctctttcatttttctttgaacaaagcaaaagacataaattgtgcatcatccgggaactataaacaaatgatggaacagacacaacttttatgctgtccaaaacgtctaatgattaaatacagatgtaaggagaacctacgaatgaagagaaaaataagaaaagacaaactaaaagaaatgaaggacttttaccgttcagtcctgctgatttcacttggcattactatgatcctgatcttccaggcaatgctcatgtagaaaaaaataaagacacgccgctaaagcgtgtcttacagtatgtttggactttttaatcctcaggcaaaggtttcttagcagagatcatcagcagttttttcagcttatgtacacgaaactttgtgagccccgctgccttgaacatgccaaggatctcatgggtggatggccgcttcaccttgcaggaaggaagaagcttgtccgccacgttgccggtgatcctgatcacttcagggaatgcaacgacaccgatgtaaagccttccgccaggagtcaggagatcggccgctttctggatgaactccgcctgattggggaagtgatggaatgcgctgcacacagttatgatgcggaatgtattgtcctcaaaatccagatcatcactgctgcctacctgaaaatgcaggtcaggataatcttcactggcccggcggatcatttctccggagatgtcgactccatacccttcagcatctctccagcgtgtgagtccggcgagcagtgctccggtcccgcatcccacatccagaattttatcattgtctcggacacagatcttcttgatcatctcctgctccagagaagccgccatcctgccgctgatggtcttttcatacttttcagcctttttatcgtaaatttttgcagaacgttcttttacatttttcataggtacgtcctctctttcttcattttactctattattctttacaatgattatatcagataaacgaaaacatccgcaacagataaacccaaaatgtgagactgacagatgaaagtacggttgcggccaccacgatgctggaagtcagcacatgatcgttgtccatggccttcgccattacatagcagctcacggtagtcggcgagccgagcatgatcaggattgcgatcagtccttcgttccggaaaccgaaaaaaacggccaagggaagaaagatgagcggcagtataaaaagtttgatgactgcggcggccatcgtaggtcggattttcttcagagcctttgcgccttcaaaacctgcgccgacacagagcagcgccaccggcgtcgccgtaacggaaagctgatttaggcatttatcgatgaccggaggaaaatccacagccagataggaaaacggaagtccagcaaggattcccaggatgatcgggttttttgcgatattgatcagggcagatttgatactgcctgtgccggaacccggtcccctgacggtcaggacgataacagaaaaaatattatacaaaggcacgctggcaacgatcatcagcggtcccatagtggagtgtccgtaaatattctcaatgaaggcgattcccaggatggcggcactgccccggaaagaggcctggacaaacgctccggtcatggatttatcttttaagaaaatttctgcaaggatccagatgccggaaaacatcagagtggtgacgatcatgcagaacagaaagtatttaagatcaaaggcctgtttcaacggggcgccggaaatatcccggaacaaaagggccgggagagctgcgttaaagacaaatttattggccgtgtttacaaagttttcattaaaccatcccttttccttcagaaaccatccgagaaagatcataaaaaagatagggactgtcgaatttaagctgaaaataaaatcattcataagtatcctccgggggagattatagcaaataaaaaagaacaattcaaacatgccaatttttcttgctaaatccaaattgaggtgatatagtacccttggatggtattccttagagaaatcataccagtgaacgaatcttataaaggacatcacctcaggaaagcaggtgattattccgtatgaaagcagggtttatcggggcaggcaaagcaggctgttcccttggcaggtatttcgtacattacggcatccctctggcagggtatgccagccgcagcatggcttcagcccaggcggcggcagacgcagcacacacacaaagttttgattcatttgacaaattattatcaatgtgtgatgttcttttcattacggctcctgacggccagatcaaaggcgtgtgggagcagatcagagctttcccggtccggggaaagtttatctgtcactgcagcggttccttaagttccgctattttctctgaaataaccgaagcaggggcttacggctattctatccatccaatgtttccatttaacagtaaaaaaacttcatatgaggatctttccaaagccttgtttacccttgaaggtgacagggagcacagagatcagatgctctcatttttaagtgttctgcccaacccggtcgtggagatcggggcagaggataaggtccgctaccatgcggcggctgtcatggcgtccaaccagatggcggcgctgatgaaccgggctttaagaattcttgaaagctgcgggttcagcgggcaggacggccttacggcacttgctccgcttgttcggacgaatcttgaaaatattcttcgttcgggaccgaaagaagctctgacaggaccggtggagcgaaatgatgcagctactgtggaaaagcatttacgtgctctttccggagaagagaaggagatctaccttcctctgtgcagggagctgataaggattgcagaaagtaaatatccgatgagaagctatgaacatatggagagaatattggaggaagaacattgaagaacacagtaagtacatttcagaagatgaaagaaaacggagaaaagatctccatgctcacggcttatgactattctacagccaaactgtttgatgaagccggcattcattcaattctcgtgggagattccctggggatggttatgctaggttatgacacgacgatcccggtgactgtggaggatatgatccaccacggcgctgcagttgtgaggggagcaaagaatgcgcttgtcgtagtggatatgccgtttatgtcctaccagacgtctgtatacgatgcggtggtcaatgccggaaggatcatgaaagagacagaggccacggcagtcaaactggaaggcggaaaggatgtgtgtccgcatattgaggccatcgtcaaagcttccatcccggttgtggcccacatcggcctcacgccccagtctgtcaatgcctttgggggatttaaagtgcagggcaagagcgaggaagcggcgaaaaagcttttggaggatgccctggcagtggaagcagccggtgcatttgcggtcgtattggaatgtgttcccgcaaaacttgcaaagcttatttctgagaaactccgtattccggccatcggcatcggcgcaggagcagactgtgacggtcaggtcctcgtttaccaggatatgctgaatatgtacggggattttgtgccgaagtttgtaaagcagttcggaaacgcaggcccggtcatgaaagaggcggtgcaggaatatgtcaaggcggtaggagaagggacatttccggaagaacagcacacatttgccatcaatgatgatattatagagaagttgtattaaggagaggatcatgataattgtcagtacagtagaggaagtcaggaaacagataaaagagtggaagatgcaggggcagagcatcggattcgtgccgactatgggatatctccatgaagggcataaaagtctgatagactgtgcacggaaagaaaacgacagagtcgtcgtgagtatttttgtaaatccgatgcagttcggtccggcggaggatctggccgattatccgagagatctggaacatgatacacagatctgtgagagtgcagggacagatctgatctttcatccggaaccggaggaaatgtatgacggtgacttctgctctttcgttgatatgagcgttttgacggaagggctctgtgggaaaacaaggccggtgcatttccggggagtctgcacggttgtcacgaaacttttcaatattgtaactccggacagagcctattttgggcagaaggacggccagcagctggcggtgatcaggcgcatggtgagagacctgaatatggatatctgtattgtgggctgtccgattgtaagagaagaagacgggctcgccaagagttccagaaatacatatctctcaccggaggagagaaaggccgcgctggttctgagtcaggcggtgcggctcggcgcggagcttgccaagaccgaaaaggatgccaaaaaggttgttttggccatgaaggataagatacagacagaaccgctggcaaggattgattatgttgaggcggtggacgctctgtccatgcagccggtgaagaccctggaaggcggctgtatgctggcgatggcagtttatatcggtaaaacaaggctgattgataatgtgttagtgtaaggagacggacgatgaagcttacaatgttaaaaggaaaaattcacagggcaaccgtaagacaggcggagctggactatgtgggaagtattacggtggaccccgaacttatggaggcggcaggcattctggaatatgaaaaggtggccattgttgacatcaacaacggcagcaggtttgagacatataccattgccggagagccggggagcggcatgatctgtttaaacggggcggcggcacgctgtgtatcccagggagacaagatcatcataatgtgttatgctgaaatgacaccaaaagaggcagaagaacacaagccaaaagttgtgtttgtagatgacaataacaagatcacccgcctgaccagctatgaaaaacatggccggctggaggatatgtaggagaagactatgctgagtggaaaaacaatcgtcctgggtgtcacgggaagcgtggcggcctataagatggcgaacatggcgagcatgctcataaaaaggggatgtgaagtccatgtgatcatgacagaaaatgcaaccaactttatcaatcccattgcatttgaatcactgaccaatacaaaatgtctggtggaaacttttgaccggaattttcaatttcatgtggcgcatgtgtcactggcaaagaaagcagacgccatgctgatcgctccggcttctgccaatgtgatcggaaagatcgcaggcggaattgcggacgacatgctgacaacgactgtgatggcatgcaaaagccctgttctgatcgcacccgctatgaatacaaatatgtatgagaaccctattcttcaggacaatcttgagaaactcagaacctacggttatacggtcattgaaccggccagcggacatctggcctgcggagatacaggcgcagggaaaatgccctctgaggaagttctcatggcttatattgagcgggctgtgcaccggccaaaagatcttgcagggaaaaaggtgctgattactgccggacccacgagagaagcaatttgccctgtgcggtatatcaccaatcactccacagggaagatgggctatgccctggcaaagacggcaatgctccggggtgctgatgtgaccctggttaccggcccgacagagattaagccgccgatgttcgttaccacagtgccggttgtgagtgcggccgatatgtatgaggctgtcatgagcagaaaaaaggaacaggacatcatcattaaatcagcggctgtggcggattacactccggcgcaggtgagcgatgagaagatgaaaaagaccgatggggatatgtctattccgctcgtgcggacaaaagatattttacaggagctgggtcatacaaaagaagaaggccagtttatctgcggtttttccatggagactcagaacatgctggagaattccagaaagaaacttaagaaaaagcagatcgatatgatcgcagccaacaatctgaaagagtccggagcgggattcggtacggataccaatgttgtaactttgatcaccaaagaccaggaaaaacagcttccgatgatgtccaaagaagacgtggcagatgccattttagattttattaaaacttcataaaactttattcaaatactctttttcccactttcctatgatataatagaagtaccaaaagcagcaggaaggtacggggtcatgaaagtagtgaacaaagtaagaattatatttttgccagcgattatactgccgattttcttgatggtagtatcaatcgctgctttaagtgtagggtatatccggacaaccaacgaaaacatatattccaatggaatcgaaggattcgccaatccgttaaagacgatgaacaatgagaccaagtcctgtttcaacgacttgaagaggagtgccattgagaatcccgcggcctttgaggatgcagattacttaaagaggatcaatcagaggttaaaagaaaaagagtcctatctggtcatcagaaagggaaagacgatcatatataggggaacaaaagaagatcacaccgagacggagaagaaacttcccagattcgggagtgaaatcagcagccaggacagcggagtatttctcgggaaaccggaaaattttcttgtcaagcagcaggactttcagtataccgacggaagcaaaggctctgcgtttattctgacagatttggagacggtgctgcctcattataagaatatcataagccaggtcttcttttcgattgtggccatcctgatcctcaccagttttctgctctcatggtttatgtactctgagttcataaggccgttaaagaaactcaaagaaggtgcagaccggatcaaggagggcaacttagacgacgatgtggagatcaacagcaaggatgagatcggggaactctgcgcttcctttaatgccatgcgggcggaattaaaagagtctattgaggcaagaattatctatgaaaagcagaaccgcgatctgatcagcaacatttcccatgacttaaagacgccgatcacggccatcaaaggatatgttgaggggatcatggacggagtggcggacacgccggagaagatggaccggtacattaagacgatctacaacaaggccaacgacatggatgtgctgatcaatgagctgtccctgtattccaagatcgattccaacattataccttataatttcaggaagatcgatatcaacgcctacttcaaagactgtgtggatgagatcggttcagatctggagcagaagggaatgatgttctcatacagcaactactgttccgcaaatgtagcggtcatggctgatcctgaacagctgaagcgggtgatgaacaacatcatcaacaatgcctgcaagtatactaataaagcaaagggcaaggtcagcattacgttaaaagagctggaccgcaagattcaggttgcgatcaaagacaacggtatcggtatttccaaagaggatctgccgaatattttccgcagaacctaccgcgcggatatgtccaggaattctgccggaggcagcggactgggcctttctatctgtaagaagatcattgaagaacatgggggagagatatgggcggagagcaggctgcgctccggcaccacaatattttttacattaaataaaatcgcagacacccaggaggaagagagtaatgagtagagttttaattgtagaagatgaactggccatcgcagagcttgagaaggattatctggagctgagttcttttgaagtagagattgagacggatggagagaaaggtctgaaactgggccttaccgaggattttgatatgatcattctggacattatgcttccaggtgtggacggctttgagatctgcaagcagatccgggagaaaaaagatattccgatcctgatggtatctgccaagaaggaggatatcgataagatccgggggctgggtctgggagcagatgactatattacaaaaccgttcagtccgagcgaactggttgccagagtaaaggctcatcttgagagataccgccgtctggtatccagcaacacccaggaaaatgatgtagtggagatccggggactcaagattgataaaaccgcacgaagagtctacctgaacggagaagaaaaggcatttacgacgaaagagtttgaccttttaacttttcttgccagccatccaaacagggtatttacaaaagaggaattatttaataaaatttgggatatggaatctctcggagacattgccacggtcactgtccatattaaaaagattcgggagaagattgaacttaacactgcaaagccgcagtatattgagaccatatggggtgtcggataccggtttaagatgtaggagcggtcatgagaagaaaaagagaagtaaaggtactttacaaagatcaggatattgccgtctgtgaaaagccggcggggatgcccacagccgatgacaagagcggagatatggatgtatttcacagtcttaaaaatcagctcttttttgaggagaaccttgacagggagccggagctctatgtggtccaccggcttgaccgtcccgtgggaggcgtcatggtgtttgccaggacgaaggaggctgcggcagagctgagccgccagatcagagaacatatatttgaaaaggattatcaggccattgtaaacggctggctccctgaagaggatggggtttttacggattatctgctgaaagacgataagaaaaacacatcctgcaccgtgccggaagaaacgaagggggcaaagaaagcggagctgtcttacgaggttttggatatggtggagacaggggaagggaaacttacctactgcctgattcatctcatgaccgggagacaccatcagatccgggtccagtttgccgtcagaggctttggactttacggtgacacgaaatacaataagaagtttcaaaagacgaagaaacaatatgaagagataggactctatgctaccagaatcagttttcggcatccggtgaccggggaggcatgtacctttaaggcggagccgaaagggaaggcgttttttatgctggaagaactggacgcctggtagaaacacgaaaagagggaaggcgaaatgaaattcaggccgtgcattgatattcataacggaaagattaagcagattgtgggaggcagcctgctggacaaaggagaccaagcagatgaaaattttgtttcggtacatgacggaggcttttatggtaaactatacagaaagcaccgtttatccggaggccatatcatcatactgaatcccaaaagctcagagtattatgatgcggatgtccgggaggcattggcggcactgcgtgaatttccgggaggtcttcaggttggaggcggcatcactgatgagaacgcatccttttttatcgaacagggggcatcccatgtgatcgtcacttcctttgtattttccgcaggtatgatccggcttgagagactgaaaaagctttcggatcttgtggggcgggagcatctggtgctggatttcagctgcaggaagagggacggagcgtattatatcgttacagaccgctggcagaaatttacagacaccatttttacaaaagagcgattagaggagatggaagaatactgctccgaatttctcgttcatggggtcgacgtggaaggaaagggacagggcatcgatgaggaactggtccggattcttggaagctacatgggaaaccctgtaacatacgcgggaggtataaaagattttgccgaccttgaactaatcaaaagagaaggaagaaacagagtggatgtgaccgtcggcagcgctctggatttattcggcggacctatggaatttgaaagagtccttggctattgtgattgatattggaggaatatatatgaaactatggtatgaagccagcaattttacgatacagccccattgggtcattccgtttgcaattctgggagtgatcgggctgatccttgttttagcgtcaaagaaatctttttttaagctgctcggaggagtctgccttgtgatctgtgccgtgacggctctcagattctgctatgggtatgtgaggatcatccacacatataaacaggggaattacaaaacagtcgaaggttatgtagagaattttgttccggcgtccaagggcggagagacaaatgaagatacggaacaggagagcttcgacatcaaaggggtacatttttcctacggagaccgctttattaagaagtttgggtatcatctgccttctactcagggaggatacattaagaaagatggtcagtatttaaggctcggctacattgacaccgaagaccagggatatgttattgtaaagatcgaagagcgcagagcaaaaaaataagagagttaagaagctgtggcatctgtaaaaagggtgacacagcttttatataattatatgggttatttcatgatcaggaggtgcttatgaaaaaagtagtagttgcaggatgcctttgtctggatatcacgcctgaattccacgacagccaggaaaagagaaaaactgcttcagagtggtttctgccgggcaaacttctgcaggtgggcgaagcgtcgatccataccgggggagccgttgcaaataccggacttgcgttcagacattttggcgcggatgtgtcgctgatgggaaaggtgggaaatgacgcttttgggaaactcgtgctggatattttaaatcgtcatgggggaagccgcggagctgcggtatcggaagagtgttcgacagcttataccattgttcttgcgcctcctggagtcgaccgaatcttttttcacaatccgggagcgaatgatacctttggattgagagacataaattttgatgaaattgcgggagccgatctctttcatctcggttatcccacgatcatgaggcgtatgtttgaacatccggaggaacttctggaaatctatcgccgtgtaaaagagcttggggtgaagacttctctggatctgacactgatcgaggaagactgcgatgcggcacatactgactggaagaagctgtttcaaaagctgctcccaagcgtagacttttttgtgccgagtgccgaggaaatttgttttctgattgacaaagagagatatcatgaatggatagaaagggcatccggaagagatttgacagaggtgctcgacatagagaaagatattacgccgctggcagacaggcttcttcaatggggagcagggtccgtgctgataaaatgcggtgtcaaaggattgtacctaaagaccggggaaaatttagaaatgccggaagaatggcaggacaaagaactgtttgagccaagctttcaggcagacagagtccgttctgcaacgggggcaggagatgtgacgattgccgctttccttacaggccttctggagggaaaagatcccggccgatgtcttcagctgggtgcagcggcgggagcctcctgtgtcacagagtatgactcgttgagcggactgctgagcatggaggaaatggaacaaaagatagacagaggatgggaaaagatttctataaaataacaaaaacggccggtcatatttgatcggccgcttttgcgggtatatgtcatatttttaattcttatgtttcgattctgcctatttcctgcctgaaacattacgggatgcttctatcgttttcttcttaaacttcttgaagaatcctttgggttcctgcggcggcgcaacgttgcgcagattgtggatttcggtaatatatatgccgctgactttggctttgatctcggctttgacaggcacttgatcgtagatcagctcatcacataacaatggagtgatcttcggcccgatttttacttttaccacaggtactttggcaatcttgccgcgcttcggaatctggtcgatgaccatcttcggaaaacctgcctctgtcatcttcatcttctttttatcaatgaccagcattgaatacatctgagctgcactttccaactgtgcccgctgggcttcctgcttcttctgaagtttgtttcctacaaaatacagaatggcaagaacagcaataatgacgacagcaataatcaataaaaccatccatacttgcatttctttcttcctcctggcttttcacttcttaaacttcatgccttcatacggcacgcctaaaaaacattatatcatcttttcaggccattgtcttatgtttttttctcatttcgataatttcttcacgaactgccgcccccaggtgtttctgggcctggcggtccagctggtccggatagatcggccggccgaatgtgatatggacctctgtaggcttcacagtgtattttttgttgttctccagaatatccgctgtaccgctgatagccatagggatgaccggtacctttgccttgagagctggtcttaagcttccttctttaaatgtatggggatcttcatcctgacttctggtaccctccggaaagatgaccatggaaaacccatttttcaggtattcggtgcctttgttgatggttttcataccttctttaatattctttctgtccaaaaacaggcagttgatgaacgtcatccagtggctgagacaagggatcttacccatctcatttttggcgaagaagccggcgccgtggggtgttgccacgtagctgcagaggatgtcataataactgctgtggtttccaacatacaggactgcagtgtcttcgggtatattttcacgtccgtccacgatgactttggttcctgcaaacttcagacaggttttaaaggcattcatgatcatagattgtgccttttcggttctgcggtgttcctgcccggttttgttccaatgatcaaagagaggatacagcggaaaggtcagagtcaaaaagaaaaacagatatacgatatcagcaaaaaaacgaatcataaagattctcctttcaatattctttggttttacgccttttgggacagcagctgattttttaaatcatacaaaggtttagagagatccacatagacattttgaggattgactaaacgccgtgtctcgtcccacagagtgttgagctctccggtacagtaatctctgatctccatagctgaaggattttcgtagacacactgccctttcagaaacacgggaaccagaagttctctgagtatataggttccgtctataatcgtggattttttccaggtagcgatcgggtcaaatatgaccaggtcctctttgctggaataaacttcgtctgtcaggcagatcaaatccgcacggatcttgcctgtagtcttgtcataaatccgataaacagttttatttcccggatttgtaactttggcggggttttctgagatcttgatctttgccgtaaagtctttttcaccctgatgctttgcagctgcaagcttatatacaccaccgaaggcagggcagtctgaggaggtaataagcttggtgccgactccccaggaggtaatcggagcgccctggagctttaaactctgaatgaggttctcatccagatcgctggaggcggagataatggcttcgggaaatcctgcatcgtccagcatagccctcgcttttttagaaaggtaggcaagatctccgctgtctaagcggattccgatttttctgggatgcagtccctcatctcttaattccttaaagacccggatggcgttgggaacaccggattttaatgtgtcataagtgtctaccagaagcatacatgcatccggatacagagaggcataggtcttaaatgctgtatattcgtccggaaaactcatgatccagctgtgggcatgggtgcccagcaccggaaggtcaaacattttcccggcaagtacattggaggtgccgtcacatccgccgatcacagcagctctggcaccgtaagtccctgcatcagctccctgggcacgtctcagcccgaactccataacaccgcttccgccagccgcatagacgacgcgggaggctttcgtggcgatcaggctctgatgattaataatatttaatatagcagtctcaatcagctgggcttccatcatgggagcgatcaccttcaggagcggctccatcggaaagacaacagtgccttccggaatggcataaatatcaccggtaaaatggtatcctgcaaggtattccaggaaatcttcatcaaatatgtcaaggcttcgcaagtagtcaatatcttcatatgagaaagacaggtttttgatataatcaatgaccagctcaagtccgcaggcaatggcatagccgctgccggaaggattgtcccggtaaaagacgtcaaaaatcacggtctcgtcattgccggacttgtaatatccctgcatcatggtcagttcataaaggtccgtcagcaatgtaaaatttcgagtcatcattccccgatatctcctttgtgtagttagattttgacttatcgtcatttttatatattatatcataaaatgtaaagtaaaaatcatgagtttttactgcagtttccgtcgcgggatgaattttagagttccgtttccagtatattcaggagctgctctccgacggattcttcattcggtccctcaaccgtgacggatatctcatccccgcatccggccccaagggccatgagatcaatgggattttcggcagcagcctcaatacctctgcaggaaaggacgatggagcagccggagtttctggctaaagcaatgatagacacgcagggacgggcatggagtccgttcggcgcctcgattttataagaaagtgttttcatgagataaaacctccaaatgttacctgatttattttggtattttgatataatcttattactatctatggtaacatattgtgaaagagaaaatccataaatttgtttggagaaaaagttttttatgtcatttcttaagatttcatcatccggaggaagacggagggagggccatggagagagggaagaagacaaacaaagacaggctctttgagcaggttgaaaagagggcaagaggcgaggcgcagggagttgatgctactcatctcgcccaaagtcttggaataccgagaaatcttgcaagcagtctgctcaatgaactggccgcagagggaaagatccggaagaaaaagacgaggccggtgttgttttattgtgactgcagggaggaagatcaggaggaggaagatccattccgtgagtttataggatttgataagagtctgagggaacaggtggagaagtgccgcctggccgccaattaccccaacagggggatgccggtcatgatcctcggacccagcggtgtcggaaagagtctgatggcagaatacatattccgctatgcaaaatttaagaaactgatcccggaagatgcaccgtttgttgttttaaactgtgcagattatgcgaataaccaggaacttttatcttccatactgtttggatacaaaaaaggggcctttaccggagcagccgagacgacagaaggtcttttccaaaaagcggacaaaggatatttatttttggatgagtttcacaggctcccgccggaaggacaggaaaagctgttccggtatatcgacaagggagtggtggcaaaaatcggtgacagcagcagtgaatccagggtcgatgtccgccttatctttgcgacgacagaggatatcagttcgatgctggatacttttatccggagagttccggtcatgattgagattcctccgtttgcggagagaacgatcgaggagcggtttcagattatctgcaggctgtttttccaggaagcacagacgatgggctgcggctttctggtcagcagcaatgtggtgaatcagcttttaatgctggatttaaaaggaaacatcggaagcattaaaaatgcggtcaagttaagctgtgccagtgcattctgccgggaaaaggcagaacaggtcagggtcaaaatccgagatttaagtgaccactaccggtttgagcgcggaaaaacccaaatacagtatattacggaagcggttttgatagataaagaatggagtccgaaaaagggttccggaccgaagggggaaaagatccggaacaatctggactggacggaactttgccgtcttctcgggcgttatcaaaatcacgggatgactcaggaacgtttccggtccaagatttacaggatgctggaaaagtttacgggaagtgtcatggaattaaccagtgatgaaatgtcggaggcaatctatcagggtgcgatcgaaaagatccttggttaccttcaggaaaattatggactccagtataacggcacaatgctgacagtattaagcaggatactgctgctgttcagcagagacgacggattttcggaagaagatgtcgaggaactgagaaagatcgaggagctgatcagaagccagctgtacagatgctataagatgagtgcaattttttatgaaatggccagacagaccattgactatgaggcctgtccgcagatgatccgggtatttacggcactttatttttactgcaggatggatgtacagaatgatttgagcaatgcggtgattgttgctcacggtcacgctacggcttccagcatagcgagtatggcgaaccggatgtttggacagtacatttttgaggcattcgatatgccgtttgatatttctaaaaaagaggtcgtaaagaagatcagaaattatttgaaaagagtcgatacgtccagaggacttctgctgtttgtagatacaggatcactcctggacatcgcggaagatatccaaaacgacgtagagggagatctgggaatcatcaataatattacgacacagatggcagtggaggcgggagaacgcattctcaaaagagagggaattcagtttgttgtggagcaggtggtgaaacataatgtcacgaattttacttatatcaaacagcgcaggaaggcagatgccgttgtggtctgctgtattaccggcattggaacggcactgaaaatacgggatatgttaagggaaggtttccgcgagacagaggttgagatcgaagcatgcgaatatcaggaactggcgtctgaaaaactgcagtgtgaagtgtttcacaaatataatgtactgtttattatttctacgattgaactgaatcttccggaaaagccggtgctgctcttaaacgaccttgtaacggagaaggggaaggctctgatagaagacggcttaagaggcaagtatacagagagggtgatccgacaggtgatgacaaatatcattaagggtttcagtatgagaaatattataggacagctgacgatactgaatcccgataagatcatcgtggatgtggaagaagccgtagagaagatagaggatttcagccgatcggcattttcggtggatttgaaaaaaatgctgtatatccatatcagtattatggtggaacgcctgattctggaaaaagggcggctgcctttagaagatgaatcacaatttgccaagtgtcattctgagtttattataaacgcaaaaaacagcttttctgtcatagaatctaaatataatgtgtcagtaaatcaaaaagagctgaaattaatttatgaattaatcaccgggaaaagcggaggtcctgcatgaaaatgcagggctttcttttttctctgaagtttttgcattaaaagttggcacaaaaattgctgtatagctttatataaacaatttacagctgcatgcaaaaggagggccgagatgattgaaatggtgatagcagcgcacggagggtttggaaaagagctgctgaatagtgtatcactggtcgtgggaccggtggacaaatgtgccgcatggtccctgaatcccggggataatattgagagaacaggacttcagctgaaaaaactgctggatgagatggacgatgaggaaggagggattgtctttacggatatctggggagggactccggccaatctgtcacttaaatactccagaaataaaaacattaaagtaatttccggagcgagcctgccgatgatacttgagtttataaatgtgagagaggagctgggtctttcagaaactgcagagcgctgtgttgaagcggcgagaaaaggatcggttatcatcagtgatctttttaatgaaaggaggaaggaaaatggctgagattcaaattgcaaggatcgactacaggctgattcacggacaggtagtgacgaaatggatgaaggcttatcccgcaaagcgcattgtcattgtggatacagagctggcgcaggatgattttatggatgatatctatgcgatggccgcgccggcaggaacgaaagtggatgtggtggagacagaccaggcaaaaagttttttggaaggaacgaaagggagtgtgtttttactgtttaagaatgtagaatcctgttttgaagctttttctgacggtgtgatattctcaaagctggtcgtgggaggaatacctacggatgcgggaaaagcccttgtttacagcagcatttatatgagtgcgtctgagtatgagaagctggaaaagatcagcgatacagggatacaggtaattcttcagtccacaccggacgactcttatgcagaactttcaaaaattaaagaaaaactataaggaggatttgttatggatgtacagacgttaatcatggccatcgccatgggtgtgctctattggatagccaacggatatctgggatatacattgtggatatcagtgggaacgccgtttaccatgggattggtcgcaggactgatctacggagatattgcaacaggtattattttggccggcagtattaaattgatctacctgggagtcttcgcaccgggaggacagctgccggcggatgaaggaatagccgcagcatgtgtcatccccattgccctaaagaccgggatggcaccggaggtagcgatttctctggccgtgccggttgggcttctgggagcattcctttataactttaaaaagattgcaaactgcatgtttgttgtaaaggccgataagtatgcagaggaaggcaacatgaagggggtatggcggtgtgcaagtatctggccgtttcttctcagtgcactgctctttttcctgccggtatttctggtaaatatttttggagccgacgtagtaaaacctgttttgaatgcaattcccgagtggctgatgcacgggctggaagttgccggaggagtgctgcctgccgtgggatttgcaatgatcatttacatgataggaaaagcaaaatatatcccgctgtttctcatcggtttttacctggtgaagatagcaaatatcaatacactggttgcgggcgtgtttgcagtctgcattgcagtcacagccattgtactgaagagggaagtaaaggaggaactggctgatgagtgaagatatgaaggtaaaagaagcagttgaatcagaaagcagagaaggctcagtcctcaccaaaaaggatattgacaaagcctacttccgctggtggatgacggcggaaataagcgccaactatgagaggatgcagggccttgcatatggggcgagcatgatcccgatcctggaaaagttatatccggagaaagaggatctttccgaagcgctaaagcggcatcttgcgttttttaatacagaggcaacatggggcagcatgattttcggaagcgccattgcgatggaagaagagagggcaaaacataagaaaatgcccggagaaatgatcaccagttacaagaccggcctcatgggaccggttgcaggaatcggcgatacggtggatctggcgacgatctttactcttgtaagcgcattctgctgcagctttgcgatgaaaggaagtctggcggctccgattatcatgttcctgttaggggcggctatgtatgtagaagggctgatcttccacagagccggatacaaaatgggacgttcttctgtgaagaatatcatgtcctccggtaaattaaaggatatgataaacggtgcaaatatgatcggtatgtttatgatgggtgcgttatccgcaggtttggtcagcctgtccacagtagtcaaaacaaagtcttttaacctgcaggagacactggactccatcgcacccggaatattgcctctgctggtgatttttctggcatatttcggactaaagggaaggaagatgtctgcaccgaaaattgtcatcctgattattcttgtgtgtgtagtgggatctttgctgaaagtattataaatataatgaaaataaagaaggtggtattatcagtctgatcagctgtaatttttactccagggcgttgggacgcagtaccaggttctatgcggctctgccgaaggaaacggtgggaggaaagcttcaggtgctttaccttctgcacgggggaggggacaacgagacaaagtggcaccgcagagtgcctgtggaacggattttttccggtctgaaagttttagtcgttatgccggacggaggcctcagctattacaccgatacagtgtgcggagaaaactactggacctatctgagcgaggaactgccggaggtcataagaagttattttccggtatctgaaaaaagggaagatacatttacggctggactttccatgggaggatacggagccatgaaacttgcgctgcttaaaccggaacggtttgccaaagcggcaacattttcagggagccttgacatggtgagagagatcggggttgtcatgtccgatacgaaggaacgggaagaatttcttggggattacgaaatggatgagacattttatacatccattttcggagatttagacaaaataaagggcagtccggcagacatttatcatctgctggaaatgcaccgggggaaaacagagcatctgcctgacatctatcaatgctgcggtacggaagactttttatacaggtttaatctgctctttaagaataaactgaaccatatgggggcagggcttacgttcgaagaatggccgggaggacatgactgggtattttgggaagaagccctccgccgctcagtcagatggttttcatttaaaagagagtatatctcagacggggaggtgtagctttggcgtacatactctgtgatttttattccaggtcattgggaaaagatacggttattcatatgatttttccggaatatggacagatcggtaaaaagaagattaagatctgtactctgctgcacggccagagccaggatgcttctttctgggtccgcagaacaaatatagagcagattgccggggaagagaatatggctgttatcatgccggaggcagcgagaagcttttttgtgcaaatgcccaatgaaagaaattttcaaaaattcctgcgggaagagctgccggaatttttggacaatacgtttccttttttatcaaagaatccggaagatcacatgatcgcatccagcgaaaagtcttgtgcagggagaatgaaagatattgtgtcagagggctgttcttattacggacggtggagctgtcttccgcgtgattttacagatgcggacctgcggtttctgatgtcgggaacagaaattcatgaagatggttgacatttaaaaatgcctatactaaaataaacacaaataaacattttcaaagagcgttgacagagacagtacttatgctgtaaaagcagagagcgagtcaggggcggtgggagcctgatgcaagtagcacataaggaatatcactcttgagctgcaagctgaacaaagtaagctgtgccggcatcctccgttatcaggataacatatgtcagtatgtgaaataggtggtatagaagcagcaagtgttgtcctattttaggacagcacttttttattttacagggaaggccgcagaacttccctatgaaataaaaacgccgtctaagaaaatcaaaattaataaaaaaggagaaatagacgatgtacaagaaagtatcttccgacctgaattttgttgaccgcgagaagcagaccgttgagttctggaaagaacacaagatttttgaaaagagtatcgaagagagaaaaggggatgacacctatactttttatgacgggcctccgacagcaaacggaaaaccccatatcggccatgttctgacacgcgtcatcaaggatatgatcccgcgctatcagacgatgaaaggccacaagatcatccgtaaggcagggtgggacacccatggtcttccggtagaactggaagtggaaaagaagcttggattagacggaaaagaacagatcgaagaatacggactggctcctttcattaaagaatgtaaagaaagtgtctggaagtataaaggcatgtgggaagatttctcaggtgtggtaggcttttgggcagatatggatgatccctatgtaacttatcacaacgactatatcgaatccgtctggtgggcattaaaacagatctgggataaaggtctcctttataagggatataagattgtaccttactgccctcgctgcggaaccccgctttcttcccatgaggtagcccagggatataaagatgtaaaagaaaaatcagccattgcaagatttaaagtgaaggatgaggacgcatatattctggcttggaccacaaccccatggacccttccttctaatgtggcactctgtgtgaatccgaatgagacttatgtcaaagtggaaaatgacggatatacttattatctggcagaagcgctctgtgacagtgtactcgaaggtgaatacaaggtgcttgagacatacaaaggaacagacctggaatataaggagtacgagccgctgttcccgtttgtgacaccgaaagagaaggcatattacgtaacctgcgatacctatgtcacgctgacagacggtacaggagtggtccacatcgcccctgcatttggtgaggacgatgctcaggtcggcagaaaatacggactgccgttcgtacagcttgtggatgaaaaaggtgagatgacaaaagagacaccttgggcaggaacgttctgtaaagatgcggataaactgatcctgaaagatctggaagaaagaggtctcttatttgcggcacttgactttgagcacagttatcctcactgctggagatgtgatactccgctgatctactatgcgagagaatcctggtttattaagatgacggatgtaaaagaccagctgatcaagaacaacaataccgtcaactggattccggaaaacatcggaaaaggacgtttcggggactggctggaaaatgtccaggattggggcatttccagaaaccgttactggggaactccgctgaatgtctgggaatgtgaatgcggacatcagcacgccatcggttctattgaagagttaaagagtatgtctgacaactgcccggaggacatcgaactgcaccgcccatatattgacgatgtgactgtaaagtgtccggagtgcggaaaagagatgcgccgggtggaagaagtgatcgactgttggtttgactcaggttccatgccgtttgcacagtggcattatccgtttgaaaataaagaaatcttcgaggagaatttccctgctgactttatatccgaagcagtggaccagacaagaggatggttctattctctcctggcaatctctacgctgctgtttgacaaggctccatataaaaatgtcattgtattaggtcatgtccaggatgaaaacggacaaaagatgtccaagtccaaaggaaatgcagtcgatcctatggaggcactggcagagcatggggcagatgccatccgctggtacttctatacaaacagcgccccatggcttccgaaccggttccatggaaaagccgtgactgaaggccagagaaagttcatgggaacactgtggaatacttatgcattctatgtgttatatgcagagatcgatcagtttgatccaacgaaatacagtctggatcatgacaagctgccggtcatggaccgctggcttttatccaagctgaattctctcgtgagaactgtggatgagaatctgggcgcttacaggattccggaagccgcaagggctctacaggaatttgtcgatgagatgagcaactggtatgtaagacgatgccgtgagaggttctgggcaaagggaatggagcaggataaaatcaatgcatatatgactctttacactgcgttgacaactgtctgtaaggcagcggctccgatgattccgtttatgacggaagaaatttatcagaatctcgtaaaaagtgtggatcaggaggctcctgagagcatccatctgtgtgacttcccggctgtggatgagagtctctgcgacaaagagctggaagaaaatatggacgccgtgttaaagattgtcgttctcggacgtgcgtgcagaaacagtgccagcatcaagaaccgccagccgatcggacagatgtatgtaaaagcgccatcagagctgccggaattctatcaggatattatccgtgaagaattaaatgtgaaagccattgagtttacagacgatgtttcaaatttcaccacatacaatttcaaaccgcagttaaagacagtgggaccgaaatacggaaaactattaaacggcatccgcaaacatttgacagagctggacggaaacaaggccaaagcagagctggattctaagggaatgcttgagttcactgtggatggcatgccggtggaactttccgaagaggatctcctgatcgaaatggtgaagcaggaaggctttgtgacagaggcggacagtgactttacggttgtgctggatacgaatctgacagaagagcttctcgaagaaggctttatccgggaaatcatcagcaaggttcagtctatgagaaaagaggcgggatttgaagtgatggatcagatcacgatttcttatgaagcaaatgaaaaagttaaagagctgatctcaaaaaataaaagtactgtcatgaatgatgtgctggctacgggaattgtggcaggagaggcagcaggcttcataaaagagtggaacatcaatggggaaaaagtaactcttggagtgaaaaagaacgaagaataattattaaataaagatgaaaaagagatgggcgggatatcatcagcagataggtattccgcccgccttttgcagataaaaaggaacaatatgtaaacgataaagtattgtataactttaacttttttagcatagataaaacgtctggctgggtaggggtaaatttaacacctcgtttgagcatacctagaactttttttgctttcgtttggacgatctgagcggtatgttagctggttaactttaaatgattcccggaaatggtatagggacgcttgatatatttttctgttacagggaacatatcctgtattaagaaaacactttcgctgccggtatccaattttgcgatatgcaggatatcacaaggccggccatcagaaatgcgctgatctatgaggttttcatatttctttatcttactgctcataggaatcatccagtaaatttcatgtgatgtatctcgaaaacagtagtactgcggtctggattcaagtttattgcctttcaaatatggatcgttcatatcgtggaaaaattcatcttttataatatagaatcctaagatttttatataaatatccctttttagtataattatgtaaatatagattataaaaacttcccacaatttgtgggaagtttacaacccaactatttgtataccgcatattggtcagcggtaaactttatatatttatgataacaaggtttttatgcactgtcaatatttatttctatttatatacaattattatgaattatgtaaagtgatttttggaatacattctgcctgtcctgaataaaataataagacggacaggaagggggattttaatgagaaataaattgtcctaccttttctttttgctgtttctgttctgcagtgttccatatctgctgacagtggtgctttcaggaaaagaagaagcaaaacctgtggattttcagacccacaccagcggctacactgtgacagtgagcggaaaaccgatggatttagaagcctatttgctgggtgtactgccgacacagatttctatggatgatgaaaaagaggcgttaaaagcccaggcggtcattttgaggacagatattctgcgaagaatcggtgacaaaaagaacataagccaggattctcttccatataaatatgagtcggatgacaacttgcaggaaaagttaggggaacaaaaatataaaataaccgatcagtcaagaaaacaggcagtcggggagacgacaggagaggtcattacatatgagggaaaatatatacagccgtatttccatggcatcagtgtcggtactactttgagtgccaaagaatggttaggaaaagagatcccttatcttcaggaaaaagacagcctgaaagatgtggaatcaccggaatatatgactgggattccagtgacatatgggcaggtggtgactcagctgaaaaaggagaataagatcagtctgtcagtggaggaagccaagaaatccattcggatcaaagaaaagacaggaaacggttatgtcaaaaaagtacaggtcggaaaatatgttatgaccggagaggcttgggcaaaatgctttcagctgaactctacgaacttttatctggagccgtatgacggcaagctgaggatggtagcgctgggaaaaggccttgggctcggactgtcccaatatggagccaatgagctggccaaggacggaaaaagttataaaaatattttaaaatattattatacaggaattcaaattacaaaaatgtctgatcagtgaataaagcctcagaattcggtaaaactatcactgaggtgatgaaaatgaaaggacataaccgggacgtctcttccccattaaagaaatactatgcggtgatgctggtaggactggccctttttatcgggatcatgacatattacagcatagaatttaaaaataaaagagacttagcaaaacagcaggtagatttaaacaaggattccgtcggtgtcaataacggggctaccgagggaacaacagaagcaacgaccacagaagcgacggaggcagagactgaaaagaccacagagactatgaaccagaatacggtatcatatgatggaaaaacaaagcttgcctggccgctgacaggaaacgttctgatgccttacagcgttgactccactatttattttgaatccctggaccagtaccgggtaaataagggaatcatgatcgaggcaaaagagggaatggcagtaaaagctccgaaaaacgcaaaagtagaagaaatccgcaagaccgaagaatatggacagactgtactcctggatttagggaacggttacaccgcactctacggacagctgaaaaatctcgctgtgaaagaaggagatacagtgacaaagaaccagattcttggtaaggttgcggcccctactgactgctttacactggagggtgcaaatgtatacctgcagatggaaaaggacaagaagacaattaatccaaccagttatttagaatagtggaacaaagatctgaaaatatcgtatactatataagaagcaaaaataacagtcaatgtactttttactttactttgcttttaagggtatcttacttttcacatctttggctgctgtagaagaaaggctgccgcttcggcagctttttcttcgaataaacgaaggagaaattgagatgaagaactatacatatgttttaaagtgcagcgacaagagtctctacacaggatggaccaatgacattgaaaaacggctgaagtcccacaacgagggcaaaggcgccaagtacacaagaggccggacaccggttgagcttgtgtacttggaggagtttgatacaaaagaggcggcgatgaaaagagaagccgctataaaaaagatgagccgggcagagaaattaaagctgcccggcataaaagtatgagttatatgcgaatataaagagaacgaaaatatacagtaaatgtggtggtagatgttccgttatgaagccaaaaatgtatggttgtattggagcaataataattataaactggtattgatctatttccagctgttatttggagaactgcaatcattttatatcctggtaccgaagacattgagtaggttctttctccagaataactattagcggcaaccgtgatacttgtatttgcttctctcataatacaatagtcttttagcttatttgagttctctgagacttttgtatttaacaagttaaaatcggattgattagttttttttataatttctgattttaaattatttaaattagtatttaagtcattaactctgtttattaattcattgattgattccgtatgctcttgataagcttcaatatttaccagtcctttggagttcagtaatacttcaaaaggtgctgtattggaagtgttaaaataaaaatcccatgtaacagaataacccggactttccgtctcggaaggaatatgcttcgcttgcgatgcttgtgaaatacaaaataataactcaccttcatctgggtcttctgcaaaaaatccaatttgccataagtcataacttgcctttaaacctgtgttctcaagaagaaccggaagaattgatttttcaccttctgtcctggagggttgaagtgtaatgtcatatcctccttctgtgacatctgtctgctgtcgaagatctacaacagggacctgtttggcacctgttgtaactcttgtgatttttaaagtctgtccctgaagtagtttcgcctgcaatgcttttcctttgtctgttaatactgtgttttcccaaatatccataacattacctcctggtttgttatactttataaaaaccaatgaaaatatgtgacaaataacagttactttaaaaagtatcagaccatgatctctataaagaatataacatgataaccgagggtaatgtgggcaagttaagtttggaacaggtgataaaaatcctatttttacacggaataataatttgcagtaattacaattgcacttccttttgtgatggtatttgcagtgcttatacacaaatctccataggtatttatatgtccgcttatagcaaatcctgagtattttaatgaacatgatattgccacagatcgattaccgtctccgagaggcagtccgttcagtaatgtccaggaattcccaccggaaagatccacagatgttataattactatctgtaagcaaaccttttttccgtatgtaaaatatccaccaccatctattgaacatctattagaagtaggagtgggaactgtccagagcggtgtatggaataaagctgaaattaaatcattaaccctacgattcactttactaatcgcctctgtatgttcccggtaagcctcgatatttaccaacccgctggaatttaatacaacttcaaagggtactatattggaagtattaaaataaaaatcccacgtgacagaataccccggactttccgtttctgaaggaatatgttttgcctgtgttgcctgcgcaagacaaaacaatatctcaccttcatccggatcttctgcaaaaaatccaacctgccataagtcataactttcatttaaacctgtgttttcaagcagaactggaagaattgttttttcaccttctgctcttgagggctgaagtgttatatcatatcccccttctgtgacgtctgtctgctgccgaagatccacaatcgggacctttttggcacctgtcgtaactcttgtgatttttaatgtctgtccctgaagcagcttagcctgtaatactcttcctttgtctgttaatactgtgttttcccaaatatccataacattacctcctggtttgttatcccttaaaaaagccaatgataatatgtagcaaataacagctactctaaaaacaccagatcatgatctctataaatactataacatgatgaccatgggcaatgtgggcgggttctgtatggggcactataaagagaataatgtaagttatagtttcacataaataaatcttattaaggcaattgcagaaacagcgccagttccatgattccaaaaatatacttttgaattatcacaataatgacaagtaactcttggggagtttgttattgcacattgtgtgaataaaagtttatatccagataaagttggaggggataaattatagtttactgatgaagaggctccaacactataagacatccactgttctcttattgcaacataatttgttagcttatttgtagtctcgactattttattgtttgcagaacttaatttatcgttgagatcagatattctgctattcacctcattaatcgcttctgtatgttcctgataagcctcaatattcaccaatccgctggagttcaatacaatttcaaacggcactgtattagaagtattaaaataaaaatcccacgtaacagaataccccgggctttctgcctcagaaggaatatgtttcgcctgtgatgcctgtgaaatgcaaaataatatctcaccttcatctgggtcttccacgaaaaatccaacctgccataagtcatagctttcttttaaaccagtgttttcaagcagaaccggaagtattgttttttcgccttctgtccttgagggctgaagtgtaatatcatatccccctgccgtgacatccgtctgctgccgaagatctacaatcggcacctttttggaccccgtcgtaactctgttgatttttagagtctgcccctgaagcagtttcgcctgcagtgcttttccctggtcggtcaatactgtgttttcccaaatattcattttcttctcctttgtaaaaaattgatttgttaactgcagatatgaatatagcatgatgaccgcgggcaatgtgggcaagttgaatttggggcaaaaaaaagaaacacaaaaatctctgtgtttcttttttttgccccaatatgctgtcttcaaatatagtgttaaataaaaaacatcatgatcaaatggcaggcgcttcctcccatgacgaacagatggaatatttcatgcagtccgaaattcttccagtggttttcaaaccaggaaagctttagggcatagatgatgccgcctacggtatagatgataccgccggccaaaagcagcccgaagcatacggcagacaatttcttaaataacggggcaatggcgataacgcaaaaccagcccatggcgatgtacatgacagatgacacccatttagggcaagtcacccagaacattttaaaaacaatacctaaaatagcaatgatccaaatggcagtcagcagcccgtagcccactttgccgcccagtacaatggtacagatcggtgtataggaacctgctatcaggacaaagatcatggcatgatcgagttttttcaaaaccttcatcacatgctcagaagaataaacggaatggtaggttgtgctggctccgtacaggccgatcatactcagtacaaagattgtcagtgaggcgatacgaatataatcgtgagtctgaacactgctgacaatcaagggtataccggccacaacggacagaaccatgccaataaaatgagtgattgcacttccgggatctttcagtctaaaattcatagtgtatatacctccgataaaaacttgagtcattcatatattatatgtagtaatgaaaactatattcagtgtatttatatactactactacaacgaagccatttcaaggacttttcttatatttataaaaagttaagatattatttgacatatgtcagaaatatggtatgataataaatgacatatgtcagtaatttaccaaaggagaaaacggatgccgagacccagaaaatgcagaagagtctgtgccatgcctgagaatcagggctttgagccgctgggaaaacagggaaaatgctgcggtaacaaaattgttaagatgagtattgatgaatacgaaactattcggctcattgattgggaaaaactcactcaggtgcagtgcgcagagcagatgggaattgccaggactacggtcacaggcatttacgattctgccagaacaaagctggcggacgctctcattcacgggaaaatgttaatgattcagggcggggattatacactctgttccggagataaagaaaattgcagcagacgctgctgtaaaaaagaaaaggagaaagaaagatgaagatagcagtaacttatgaaaacggagatatttttcagcattttggacacacagagcagtttaagatttatgagacggccgatgggaaagtgttaaacagtgtagtcgtatctactatgggaagcgggcacggtgctttggcaggatttttacaggaacacggggcagacaccctgatctgcggcggaatcggcgcaggggcgcaggaagctttaaaggaagcaggaatcactctgtacggaggagtttccggaagcgcggatcaggctgttgaagatctgcttaataatgaactctcttatgacgaaaatgtcatgtgcagccatcacggtgaagaccatcatcatgaaggaaactgcggggaacacggctgcggccgtcactaattgtcgagagacaggcgcattgtcttcttgacgcagaacatgaaaatgtgttatagttgataacgttgttgctctggattgtcagcatgcctgacaacccggagcattatttttgattgaatgagaaagatacagaggaatttatggacgcagtaagatttgatgagttgaatattaatgataaaatattaaaagcagtgaaagagatgggctttgaggctgcctctccgattcagggggcggcaatcccggtggtgcttgagggaagagacattgttggtcaggcacagacaggaaccggaaagaccgctgcatttggaataccgcttttggaaaagatggatacaaaggtgaaaaagcctcaggccatgattttatgtcccacaagagaactggcgatccaggtggcggatgaaatccgtaaattagccaaatttatgcatggagccaaagtacttccgatctatgggggacagaacattacgaatcagattcggtccctgaaaacaggagccaatattatagtaggaacaccgggccgtatcatggatcatatgcgccgtcatactctgaaattagaagatttgaaaatggttgtcctggatgaggccgacgagatgctgaacatgggattcagagaagatatcgagagtattttaaaagaagtaccggaagaaaggcagactttattgttctctgccacgatgccgaaggcgattctggacattacgaaaaaatatcagaaggattccaagctgatcaaggtagtgcgcaaggaactgacagtaccgaatatcgagcagtattactatgaggtgaggccgaaacagaaggttgaagtgctctgccgtctgctggatatgcattctccgaagctttccatcgtattctgcaatacaaaacgtatggtagacgaagtgacgggagaactgaaaggccgggggtactttgcagaggggatccacggagacctgaagcagagccagagagaccgtgtcatgaaaagcttccgaggcggacgtgtggatatccttgtggcaaccgatgtggctgcgagaggaatcgatgtagatgatgtagatgcagtcttcaattacgatctccctcaggatgatgagttttatgtgcaccggatcgggcgtaccggacgcgcaggcaggactgggaatgcatttactttcgtggcaggaaaagaaatttataagctgagagacgtacagcgctactgtaaaacaaagatcaaggcaagaccgattccgagtttaaatgatgttcaggccaccagagcagaaaagagtctggaggagatcacaggactgattgaagaaaacaatctggataaatatgtagatatgctggatgaattcatcaatgagactgacttcacagcattagagatcgcagcggcatttctgaaaaaacaaatttcagagaatgaggaacaggaagcacagcagagtgaagactttggcgataccggagctgaagcgggaatggtaagactctttattaacataggaaagaaaaaaggagtgcgccctggagatatcctcggagcaatagcgggagaatccagcatctccggcgacctggtaggtgccattgatgtgcatgatcagtatacgtttgtagaagtgccgaaagaggttgcaaaagacgttatgtacggaatgagacacgcaaagatcaaggggaagagtgtcagcatggagccggcgaaccggaaataaaataattaagaagcactttggaaggattcattttcaccaaagtgtttttttttgtatatttctcagggaaggtccttgacaatacatgtatggtaacttatactaaaaacagtaacaattattattatgagaggaggacgcctatgcagcctgcgacgaaaaggagcaagcagagggatgcgatcattaactttttgatgacgagaaaagatcatccgactgcggataccatttatgtaaacataaaagaagaatttccaaacatcagtttaggtacggtttaccgcaatctggcactgctgtcaagccgcggtgatatcctaaaactgagttatgacggcggggcagacagatacgatgccaatgttggtccgcactatcattttatatgcaaagagtgcggggaagtcatcgatcttaagatggacccgatcgaccatgtaaatgcgatcgcaagcgcccaatttaaaggtcgtgtagacgagaatgtcacttactttcgtggagtatgtgaaaaatgtttaaaaaaagatattgacaatacaaaatagcggtgttatgattagatcaacaagaaaacagtaatagttactgatatctttactgggtttcttgaacacagcaaaaacagtaaaataaattcaaaggagatgtataagtatgaagaaatgggtttgtacagtatgcggttatgttcacgaaggagatactccaccagaaaaatgtccaacatgcggagtaccggcagaaaagtttaaagagcagacaggtgaaagagaatgggctgctgagcatgtagtcggagtggcacagggagccagcgaagacatcatggctgacttaagagcaaactttgaaggagaatgttctgaagtaggtatgtaccttgcaatgagccgtgtggcacacagagaaggatatccggaaatcggattatactgggaaaaagctgcactggaagaagcagagcatgcagctaaatttgctgaactgcttggagaagtgttaacagacagcacaaagaaaaaccttgagatgagagttgatgcagagaatggagcaacagcaggtaagtttgaccttgcaaagagagcgaaagctgcaaacttagacgcaatccatgacactgtacatgagatggcaagggatgaagcccgccacggaaaagcttttgaaggattattaaaaagatatttcggatagaaaacatatagaaaagagactgcgcccgcagtctctttttgcatttgttaaaacgaaatctaaggattcaggatattctttacaatatccgcatcgcttaaatagactattttggaatctttcagcttcacatagtaattttctccactcttatctttggagccgatatacaaggtgagagattttgatttctttgtttctgtatccttataggtaatatctactgtgacacgggattcactgtccaggccgtattttgcgaggtctttatctttgacggagtagttctgacagtcgccgaaagtgaacactccaagtcctccggcaatgctgtccatatcatttttggatttggatgtgtaggtttttaccttgctgccgctggttacaacaacttttttcagattcccgctgctcagtgtgggaaaagtatccgtctgcatcatatcattcagagagtaagataaaccagagagaaggtctgcggatacagtataaacagtcgatttatcatccagcgtcagataatagttgtctcctgaggcactgccgatataataagtcgtctgtgttccctttttatcctttaccctgatcgtataggcggggtgttccagtccgtagtcttcaaggctgtctccgttttttagtttccggacggcctcgatcttctgaaactgagatgccatggaggtgagataactctgttccacaggaaattcgctgtctttttcataaaaccatgtaccgttccttttcacaaaagacagatcctgcccgttgttataggaaatagaggtgagatccgacatatctttaatgatcagtttgtcagaagaacttttttgtgcagactgttttttctgatacatgcggagtccggcgtacagggctagaagccctgcaaagaccagaatcagaatgatcaatgtttttttctgtctcatagaaacctccttaccttcttctccggcggaaccagacgacaaagcctccggcaatgaccatgaaaggaatgacaaaaatgatcaggatactgaagatacccgggtgtgcgatgctgttataagtcacctggaggctcttcggcgagacggaaatattatctgtactgtccagattcgctgtgacagaattcatgaacagcgtaaggttttctaaagttgaaaaagactctgttacctgtgcgtcgatgagcatattgcttccgtagacggtcagacggctgtctttctttttcttctttccgccgctgtcttttacagtgaccgattctgtggctgcggcacccagcatataggttccctgtgtctgtttcttctctgtgacggcacagccgttttcagaagtggccatgaaagattccacattgatggtatcccggacaggatctgtctgcgtcatgcctttcgagttaatcatcagcacagaatttgaggagataccggaggccatatcgccgctcacagataagttcggtatgagataataataatttccctgatagcagcgctctgcgtcggcaatatatccattggcaactttcaggccatagtcttccaaaataccatagagccgtgtcatgctcttgtctgtataggccagaagggacatgacgtttcctccttttttcaaataagtggtcagaactttggcttcatcttttgtgagatcgctggtcgggccgttgagtataagaaggtcacagtcctccggtatagatgaggcagtcaggagattcagctctgacacagagatcctggatttttccatcagatctgtgacagaagatgacagggcggtttcaccgtgtccggacgtgtaataagccttatattcttttgtatttgtcacataatctactgcactggtcagctgtccgtctccgtcaaactttgtggcggaagaagatgtattataataggaagattccgttactaaaatatcgtcgaaggagatcgaagtctgccggtctgttgctttacaggatacgacgatactgtttttttccgtgtcatactttgtcagtgcggaaggatgcagtacggggtcgatccattctaccctgaggcggctggagagagaggcatacttggtgataaaggtcctgatacggtcatcggtgttccctttttcggcgattacataaaggctgacgtccttatctaaatttttaagcagcttttggcttgttgatgagatctcatatatattggtgtcgctgatatcaatctgccggatcttctgaggcagctgtgccacaagaagattaaacaggatcacgattcctatgacaacggcagtaacagctatgctgtatgagcctctcctggaattctttgtctgaaataattgttttattttatccacttacagtcctcctaactccatcgtcttttctgaaatgcctgcacggtcaaaaatataaaaagaatgatgacggagagatagtataaaagccctccgatatcaaaaatatagttctgagcgaaattatagaaaacaccggtcaggacgaaatgttccagaatgtcatgaatgaaattttcaaatacagacgatttaatgaaataaaccgcaatacttaagaccaagccggcaatctcggcaattcctgctatgatttggttttttgtaatatgatagatcagtcctgcggccagtgacaggaacaggatggtgatgatgacgccgctgagtgcgctggtcggcacatagtttaagagattgtcaagcatatacaaaaagaataaaaccccgaaggtgctgatcgccgcaatgaccgggctctctgtcagagaagacagaaacattccaatgccgataaagacacagcccagcagataaaaagccaggatcgaagaataatccaccagaagatgagcatttccctgaaacttgatgatcagaggaaacaggcagtagatcaggcagggtatggcgaacacggtgatcatcgcaaagtatttgcctaaaatgatctttgtcagaggcacaggcgaggtcagaagcagctgatctgtcttattttttctttcttccgcaaagcatttcatggacagaaccgggaccgtgatcagaacggcaaagatgacgccggacagcgaataagaaaaatagggatagccgctggtcaggttatataccataaaatatacacctcctatgacagtgagaactgccgcaaaggcacagccaatcatggaggtaaaataggagcggagttcccgcttataaattgctttcatctttttcgtctccttcctgttcctggctgtctgtgtcggtcaattccaggaaaatgtcttcaagattcgtcctggaaatataaatccgtgtgaccgggatttcttctcttgcaaaagcaagggaaatctcccggcagatttttttactgtcgccggtgaattccactgagatatcgcaggaatctcccgtgtctcctttccagcagattgtgtgtatgccggagagagaatccagaacagactgtattcgggccgggtccgacatgatggtaagctccacactatcctttccacgggacgtttcttccagttgttttggtgtaccctcggctgtcaggcgcccttttgaaataatgaggacataatcgcagatttcctgaacctccgccaggatatgagagctgagaatgatcgtatgatctttggagagtgtgcggatgagctgccggatttcgatgatctgctttgggtccaggccaaccgtcggttcatccagaataatgatatcggggaaaccaagcactgcagccgcaagaccggttctctggcggtatcctttggaaagattgcggatcaggcggctggaaacatcggtaagcctgacgagacttagaacttcgtctacctgtgccgccctttcttttccggggatctcttttagttcagatacgaaacttaaatattcccggacggtcatatcgggatagaggggcggaatttccggaagatatcccacagatcttttcgctttctccggttcttttaaaatatcgaatccgttgatcaggacttctccgctgtctgcaccgatatatccggtcatgatattcatcgtagtggactttccggcgccgttaggtccgaggaaaccgtagacccggcctttctcgattgtaaatgacaggtcatccaacgccggatggccgtcatagctcttggtaagatgttttacttcaatcaatttactgcctccttttgtgttgtctcctaacataataaaaaagaaaacgaaacaaaatgtgatgaaagtttgattcttttgtgttctccttctgatcctcagttacaagtctttttttttatttccatttctgttataatcttagaaaataatttccatgtgacctgcattgtgtgaaaaggggcggtgactatgaaggtaaaaggcgtcagactttatggggtaaaggacatcaggatggaagaatttgaacttcccgggatcaaagaggacgagatcctgctcaagatcctctgcaatggaattgccatgtctactttaaaagaaatcacgcttgcacagaggcatctgagggttccgaagaacatacgaagatatccgatcttgatcggacatgaattcgccggtgtcattgaacaggtgggtgagaagtggaaggatcagtattgtcccggagacaagtatgtagttgttcctgagatacccggacagattgagtctcccggttattcctatgagtatttcggaggagctgccacctactgtattgtcccgggagaagtgattgaaaagggatgtctgcttacttttgagggggagagcttttatgaggcaacagtggcacaggcactgtacagtattgtgggaagctttcactccaattaccacagcaaacccggttcccacgaccacatttccggtatcaaagaaggcggcaatacagtgattcttggaggatgcgggcccatggggctgatggccatccgctatgttctgactatggagaagaaaccgaaaaggcttgtggtgacggatattaacgaagatcggattgccaaagccagaaggctgattccggtgcaggaagcacagcgaaatggagtggagctttactatataaatccgtccatgatggtagatcctgcttccgctctgctggcactgaccaatgaaaagggatatgacgatgttttcgtctatgccccgccgaaaaacgtggcggagacagggaacaggatcatggccatggacggctgcatgaatatttacgcggcaacggcggacaagaagtacagggcgggcatgaacatctacggcagccattatcttaagaccaagcttatcggctcatccgggggccttagaagcgatatggaagaagctcttgagctgctccgtgacaagaaggtcgatgctgctatgaacattacccatatcggaggccttgatgcggttgtagatactaccttgtatttaaagaagatgccgggagagaaaaagatcgtgtacacgcacatctctatgccgctgacggcgattgaggattttcggaaactgggaaaagaagaccctctgtttgaacagctggcggatgcatgtgatgaggccgggggattctggaacaagaaagcagaggaaatcctgcttgactggcattcggcggaagaatagggaaacagatttttttaccgttatttcctaataacttccttgcatatttgtatgtgagttagtataatataggagtgaatttacttgacaagttcgggtataagtaggtatactttgataatcaaactattatgaggtatgaaggagattaaattatgttagagaaaatgaaggaaatcattgcagaacagttaagcgttgatgaaagtgaaattgcgttagagacatctttcaaagatgacttaggagctgactccctggacttatttgaattagttatggcattagaagaagagtacgatgtagagattccgtctgacgatctgacagagcttaatactgtcgaagatgtaatcaactacttaaagaataaaggcgtagaagattaagattgacaaaatattggcttataactgatgatttgaggttataagtcaattttttagaaacagatattttgaaactcaaagtaattgacgaggtgataacgatgggtaaaattgtttttatgtttccgggacagggagcacagtatgtcggtatgggacaagagttctatgactcttttgaacacagcagagaaatatttgaaaaagcaaatgaagtgttggatattgatgtgaaggcattgtgcttcgaggaaaatgaagacattaacattacggagtatacacaggcggccatggtgacagccagtgtggccattttaagagagatcgaagccatgggtataaaagcagatatgacagccggtttaagtctcggtgaatactgtgcccttgttgcaggcaatgtcatgagctttgaggatgcagtcaaagttgtccgccagaggggaatccttatgcaggacacagtgcctgccggtgagggagctatggcggctgttcttggcatgaagaaagaagagatcgaggcagtgcttcccggagtggacggagttgtctccatcgccaattacaactgccccggacagattgtaatatccggggaggcgaaagccgtagaggcagcggcagacgtgcttcgcgaggcaggagccaaaagagttcttccgctgaaagtcagcggaccatttcactctcctatgttaaaacctgccggggaaaaactgcttgaggtcttaaaagacgtggatgttcaggatccggagattccgtatgtttcaaatacgactgcagaatttgttgcttccaaagatcaggtaaaagacctgctgggaaaacaggtttattcttctgtccgttgggaacaatctatacataaaatgatagaagcgggagcggatacttttatcgagatcggtcctggaagaactctgtccggctttatgagaaagatcgaccggaagatgaaagtgatcaatatagagaaaaaagaagatttgaaaaagcttgaggaggtcttatcatgttagaaggaaaagtagctgttgtcacaggtgcaagccgtgggatcggccgtgaagtggcactgacccttgcgggctatggggcgaaagtcatcgtcaattactgcgggtccagagaaaaagccgaagaagtggtcgcttcgatcaaagaaaacggcggagaagccaaagtatatcagggagatgtctccgattttgatacggccaaagaaatgatggcttccgtgaaaaaggaattcggttccatcgacatcttggtaaacaacgcaggaatcacaaaagataacctggctatgaagatgagcgaagaagagttcgatcaggtgatcaatgtcaatctgaagggaacctttaactgcatgaaacatgtggcaaggattatgctgagacaaaagtccggtcatattatcaacatgtcttccgtttccggtgtgatcggaaatgccgggcagatgaattactgtgcctccaaggcaggagtcatcggtatgaccaaatctttggcaagagaacttgggtccagagggatcacggtcaatgcggtggcaccggggtacatagatacggagatgacggaagtgcttccggaggacgtgaagaagggtattatcgatacgatcccgttaaaaaaagtagggacgacaaaggatatcgcagagacagtagcatttttagcatctgacaaggcgtcctatattactgggcagacgatcagtgtggatggcggaatgggaatgtaaaggagagcagtatgaagaatttaaagagagtcgtagttaccggaatgggtgcgattactccgatcggaaacagtgtggaagagttctgggacggaatcaaacagcaaaagactggatttgctccaatcagtcattttgatgccagtgaatacaaaactcatctggcagcagaagtaaaggattttaaagcgaaagattatatagacccgcgttctgcaaggagaatggaactgttctcccagtacgccgtggctgcggccaaagaggctatcgaggattccggactggatctggaaaaagaagatacagcgaggattggtgtatctgtcgggtcgggaacaggaagtctgcagattgtagaaaaaaacaccgaagtcatccgtacaaagggtcctaacagagtcaagcctctggtggttccgatgatgatctccaacatggctgcgggaaatgtttcccttgcgtttgggttaaggggcaagagcatcaatgtagttactgcatgtgctacaggcacgcagtctattggagaagcattccgctcgatccagtgcggcgaggcagatgtgatggtggcaggaggaacggaagcctgcatcacgccggtagctgtggcgggatttgcctctctgacagcactgagcagttctgaagatccaaaacgtgcatccattccgtttgataaggaaagagacggatttgttattggagagggagcaggcgtagtagtgctcgagacattggagcacgccaaagccagaggtgccaggatccttgcggaagtcgtgggatatggtgctaccagcgatgctttccatatcacatctccggcagaagacggagagggtgcagcgcgtgcgatgcagtttgccattgacgaggcggagattcgtcccgatgatgtggactatattaacgcccacggaacgagtacaccggccaacgacaagtttgagacgaaagcgatcaaaacaaccttcggagagcacgccaaagacttgaagatcagttctacaaaatctatgatcggtcacggacttggggctgccggagccattgagtttatcacctgtgtaaaaactgttctggaagactacattcatccgaccgtaggacttaaggtgccggatgaagaatgtgacctggattacacattagagccggtcacagaccgcacagtcaattatgctctgagcaattcacttgggttcggaggacataatgcaacacttctgatcaaaaagtttgcggaatagggaggatagactatgaaattagaggaaatgaaagaactgatccaggcattatcagagtcagatgtcgataagtttgaatataaagatgatgatttctcagtgaagctgtcaaagaagaaagaaagagtcctggcagcaccggaattggcggtgccgcctgtgcctgcggctgcacctgcgccgcagaacacgccggaagctctgccggaagtaaaagaggcggaaggcaacgccgtgacggctcctttggtgggtaccttttacgcggctccgtcggaaggagcagatccgttcgtgcaggtaggcgatacggtgacaaagggacagatcattggaattgttgaagctatgaagttgatgaacgaagtggagagtgagtttgaaggaaccgtagtgagcatcccggttcataacggggatatcgtagaatacggggaacctctggtcattatccggtaagaaaggggaaacatatgctgaatattaaagaaattatgaatattatcccgcacaggagcccgtttcttttggttgaccggattgaggaaatggaagtcggaaaaagggcagtgggcaaaaaatgcgtgacatataatgaaccgttctttgcgggacattttccgcaggagccagtgatgccgggtgtgctgatcatcgaggctctggctcaggtcggagccgtgtgctgcctttctgcagaagagaacaaaggaaagatcggatttttaggcggagtcaataaggcaaaattccgcggcaaagtcgtacccggagacgtgctgaatctggaagtagaaatgatcaaggtgaaagggccggtaggagtcggcaagggaaccgcaacggtggacggtaaggtcgtcgcgtccggcgaaatcacatttatgatcggctaggaggaagcgtcgtatgtttaagaaaattttaattgcaaacagaggagagatcgcggtgcgaatcatccgggcatgccgtgagatggacatcctttctgtggcagtttgctccgaggcagataaagatgctctgcatgcacagctggcggacgagaccgtctgtatcggtcctgcgcctgcaaaggacagctatctggatatggaaaggatcattggagctgccatggcggtaggggcggatgccattcatccgggattcggatttttatcggagaacagcaagtttgtccgcatgtgtgaaaagtgcaacatatcctttatcgggccttccgcagaaatcattgacaagatgggggataaatcttctgccagaaagacgatgatggaagctggtgttcctgttgtgccggggaacaaagatgcggtttatgaagctttggagggcaggaagactgccgacgagatgggatatcctgtcatgatcaaggcatccgcaggcggcggaggcaagggcatgaggatctgcgaagattccgcagagtttgaacatatatttgaaacggcaaagcgggaagcagaaaatgctttcggagacggcaccatgtatattgaaaaatatatccgtgatccaagacatatcgaatttcagattctggctgataaatacggaaatgtagttcatctgggtgagagggactgttccatccagagacgtcatcagaagctgatcgaggagtcaccgtcaccggccattaacaaagaactcagagagaagatgggagccattgcagtcaaagcggcaaaagcggccggatattacagcgcaggcaccattgaattcctgaaggaccaggacgggaatttctatttcattgagatgaacaccagaattcaggtagaacatccggtcacggaatgggtcaccggcatagacttgatcagggaacagattcgcattgcggcgggaagacatctgacttatcagcagaaggatatccatatctccggacacgccatcgaggtaagggtaaatgcagaggatacggaacacgatttcaggccgagtccgggaaccgttacaaacgtacattttccgggcggcaagggtgtgcgcattgactctgccctgtttaccggttatcagattcctccgttctatgattcgatggttgcaaaactgatcgtatatgacaaaaaccgtgaactggcattgaggaagctcagaaatgctctgggagagctggtgctggaaggcatcaggacgaacattgattaccagtatgacatcatcaatcatcaggattttattgacggaaatgtagataccggatttattgagaggttccagaaggaacgggaagaagagacagaaagccagggtgaagcatcatgttaaaagaaatgtttaagaaaagaacattgacacctcaggagaaaaagcaggcggaacgggtaaaaaaagccaaagataccctgcttgaataccaggcgccggaagggctgttccaaaaatgcagtgactgcggaaagccggtctataacgaagacattattgaaaattattatatctgtccccactgtggaaattatttcagaatacggccgagaacaaggatcgccatggtcctggaccgcaatacctttgaggagtgggacaccggacttgccacgtccgatccgctggagtttccgggctatttgaaaaagctggagcaccagaaatctgtgaccaatctggaagaagcggtgatcacgggaaaaggaaaaattgggggcagtgaagcggccattgcagtcatgagcgctgattttatgatgggcagcatgggccaggtcgtcggtgaaaagatcacaagggccatcgagagagcaactgatcagagaatcccgatcattatttttacatgttcgggaggagccaggatgcaggagggaatcatttccctgatgcagatggaaaagacatcggcggctttgagaagacatgaccaggcgggacttttgtatatcagtgtactgacagatccgacgaccggaggagtgactgcaagttttgccatgctgggagatgtcatactggcggaaccgggagcattggttggatttgcagggccgcgagtcatcgagcagaccatcggtcagaagcttccggatggtttccagagatctgaatttctgctggagcacggatttgtggataagatcgttgagcggaagaacctgcggaaagtgcttgccaccattataaggagttgttgttatgagtcataataatttaacaccatgggagagagtcgagatctccaggtcagcggagcggccgaccagcctggactacatcacaacgatttttgaccgttatatgtctctgcacggagaccgcttatttggcgatgacggggcgatcgtaggagggctggcatccatagacgggattccggtcacagttgtcggacagcagaaaggccgttctacaaaagaaaatataaaaaggaacttcggaatgccttccccggaaggctacaggaagactatgcgtctcatgcgccaggcagagaaatttcaccgtccggtcatctgttttgtggatacgccgggagccttctgcggcatcgaagctgaagagggcggtatcggtgaggcgattgcgaggaacctttatgagatgtcttccctgaaagttccgatcctttcaattatgatcggagaaggcggcagcggcggagccatcgccatggctgtcggcaatgaggtgtggagtatggaaaactccacttactcagtcctttccccggaagggtttgcaagtattttgtggaaagacggaagcagagcatccgaggctgcaaaagtaatgaagatcacagcggcagatttaaaggaactcggagtgatcgagaaggttatcagagaacccgaacctgcaagcattgataatattatcgaactttcagaggagatcagagagatgattgttgatttcctgaaacgatataggaagaaaacgccggaagagattgtagaagagagataccagcgctttagaaagatgtaagtgaaagaaagaccacggaggtaatggaagtgaaaccattaaagatcggggatttggttgcgaaaatccctattatacaggggggaatgggcgtaggtgtcagtttgagttcccttgcgggagctgttgcaaaagagggcggcatcggtgtgctgtcggcggctcagatcggatacgacgagccggattttgagaaggaccctgagggggccaacatgcgtgccatgaaaaaacacatcaggaaggccagagagattgcgcccgacggtatcatcggcataaacattatggtagccacaaggctgtatgccaactatgtaaaggaagcgattgcaaacggcattgacctgatcatttcaggcgcgggacttccgacagagcttccggctctggcaaagggaagcaggacaaagcttgtcccgatcgtatccccgaaaaagtcggcgcgggtgattctcaagatgtgggataaaaaacatcagacggcgccggatgcgcttctgatcgaaggtccgaaggccggaggtcatctgggatttaaatacgaagagcttgtcagcgatgagacttatgaaaactatgacgatacgatccgtgagatcattgacatggtaaaaccatatgaagaaaagtatgaaaaagacattccggttatcgtggcgggaggagtttcttcaaaagaagatatggagcactgtctttctatgggagcttccggcgtgcagattgccactccgtttgtcaccactgaggaatgtgacgctgatatcaggtataaagaagcttatattaactgcaaaaaagaagatatcacaatcgtaaagagtccggtgggaatgccggggcgggccatcaaaaataaatttatggaaatcgtccagagagaaggcaggatcaagccgaagcactgttttaactgtatgtctgcctgcaatcccggtgagacagtttactgcatcacggagcgcctgatcgaggctgtcaaaggaaacattgatgatggattgatcttctgcggggctgatgcgtggaagtgtcataagatcagcacggtaaaagatgtgattggaagctatataaaataaaagattaaacgaacaaaaaatctccgcaaaaggattcactgccttttgcggagattttttgtttcaaagcagtcttcacaccaggactacatcggtcatttcctgtatattgctcaggacatctccgggaatgtcgttgtcgatgatcagatggtcaatatcatgccagcttgtgtactgtatgagggaagatgcctgagccttggagctgtcagcgatcactacattggttctggcattgggtatgatggcctgtttcgtctgggcgtcctgaaaatcggatacggccggccctttgtgctgctcaaagccgttggtgccgaggaatgcaatgtcgaccttgagagaattaatcaggctcgtggcctggaatccttcggctgccatactgttgggattcagcatgcctccggtgaggatgaccttgttgctgctgtgtaccaaagcatatgcggcttccagggaagtggtcacgatggtgtagcctgactttttgctgagcatcccggccaggcagaagatcgtacttccggagtccaggaatatgacattgccgtcaccgataaattccattgcccgttcgcagagtttttcttttaatggaagcttttcccgcaccctggattcccatggaagcggctgcagttcatagacagaagttgcgccgccgtgacttttttttaccgctcctatttcatttaaatgaagtaaatcccgccgtatcgtttccctggatacctgaaactgcttggccagctggctgatctttacgcttccattgctgtttaataatcttataatttctttatggcgttctgccgcgattaatttgcccatcctgtatctccttcgtgaatcaagctgttttaagcatagtttacttcatttttaagtgaaagtcaaatttatacagcacaaaatcatgcaaaactccaaaaaaagcaaaatattatgttgacattattggattatgaatctataatgaaagcataaagcaacaaaacgccacaatataaaaacatattgccacataacaagaagaaggagaataggatggaagcagtcaatttaaagatcatcacggacgaactttcaaagttttcaggaatggttaaagaagaagaaatccagggtttggcagatgaaattaagaaagcaaataaaatctttttggcaggagcagggcgttccgggctggcagccagaggatttaccaaccgtttgctgcatatgggatttgatgtacactttgtgggagagatctcctgcccgccgatcaaagaaggagatctgatcatactcggatccggttccggaacaacacagagcctgatcgttatgggagaaaaagcaaagaaggtaggggcaaggattgcaaccgttactatgttcccgactcataccatcggagagatggcagacgttatcgtgacagttcccggctctacaccgaagaaggcagaaggagaaaagaacctggcagagtccaatcagccgatgggaaatctgttcgagcagatgagctggctgacctatgacagtatcatcatgaatctgatgagcgatcttgggcagacaagcgaagaaatgatgggaagacatacaaacttagaataaaaattgtccagttcattttgaaactcaaagaggaggaaaagaattgcagagatttgtaaataatccggattatgttgttgaggatatgctgaaaggcttcttgaaagcccatgatgatctgattgtaaagaatgaaacaaatgacagggtagttcagtataaaaatacgccggtagaaggtaaagtaggtctggtaaccggaggcggaagcggccatgagcccgcattccttggttatgtgggagaaaatatgatggatgcggtagctgtcggagaggtgttttcatctccgtctgcccaggcattttatgatgcatttatggcggcagactcaggaaaaggtgtcgcatgcctgtttggtaactacgccggggacaacatgaatgtaaaaatggcaatccgcaaagcaaaaaaacagggagtcactgtaaaatatgtgactgcgacagacgatgtggcatcttccccgaaagagacaaaggaaaaacgccatggaatcgcaggcggtgtcttcatgtggaaaactgcgggagcgaaggctgccatgggagctgatctggatgaagtgatcgaactggctcagaaagcagtggacaacaccagaagtatctgtgtgggactcagtccatgcgcaataccggctgtgggccatccgaactttgatattaaagaaggcgatatggaattcggaatcggacatcacggagaaccggggatcaacgttcagaaactaaagcctgccaaagagatcgcaaaggatatggcaaaggcagtgatcgatgatctggaaccggaaaacggtgctgaagtggcagtgctcttatccggtctgggagcaacaccgatcatggaattatacgtactctatgatgaaattgaagcgtatcttaaggatcagggactttctatttataaggtgctgatcggagattatgtgacatcactggatatgaatggtgcggcacttacggttatgaagcttgatgaagagttaaaagagcttctggactatgatgccaaagcgcctggtttaaaataagtcattgacaacattatttagataggaaaggaacctgattatgaaattacagttagctttagacgaaatgccgttagtagatgccttgagatttgcagataaggttgcagaacacgttgatatcattgaaattggaacgccgtttgtcatggatgagggaatgcgcggagtgcgtgaattccaccgtttcttcccggataaagaaattcttgcagacttaaagatcatggacggcggatacctggaagcaagctatgcatatgaagccggtgcagcttatgcgacaatccttggagtatctgacaatctgacgatcgaaggggctctaaaggctgccagagattatgagagaaagcttgttgtggatatgatctgtgtagaagaccttccgaacagaattgcaaagatggaagagatcggagtcgatattttagcagttcacaccggagctgaccagcaggcggcaggcagagagccgattcaggatcttcaggttatgactgagcatgcaaaaaaagctcagattgccgtagccggaggaatcaacagtaagaccatcggcaaatatgtggcattaaaaccggagatcattattgtaggatcagcaatcggccatgcggatgatccggtagcggaagcaaaagcaatcaaagacgcaatgctgtaaaatacataagtagtgaggtaaagtactatggctagttttaaaaatgcagatgcaggtattattgtagaccagctgatcaagaccattcaggagcagagagattatctgagcgaaattgacgggaagatcggcgacggtgatcatggtattaacatgaacaaagggtttacgatgtgcgaagataaactcaagggaaagacttataacctgagtgaaggtttatcgatccttggggagactcttctcgacgatatcggcgggtccatgggaccgctgtacggcatgctgtttgatgagatggcaatggcctgtgaagactctgaggagattgacgccgaggtgtttggcgagatggttaccaacgctgtggaaggcctgcaggagatcagtcctgcgaaggtgggtgataaatctctgatcgatacattggttccggccaaggaagcttttatcgcagcaaaagaagaagggaaagagtttgcgcagtgcctggaggcaatgaatgaggctgccgaaaaagggtggcagtctacaaaagatctcgtggcaaagatcggacgggcaagccgtctgggagaacggtccagaggagttctggatgcaggagccacaagctgttatttcattgtgacgggtatcggcaaagcggcaatcgggctgctcaaataaatctgtctgagatacactatgtgagagattgagggatttcttattcaggaaaggctgtcatgccgggaaaccggcgggcggcctttttgcagcagattataatagatctgctgactgcaataagttatactatttatagacctaataaccaaatatcatatatatgtgggataaggaggaaatcaaatgataccaacaagaaaattgagcaacggtgtagagatgccgtacctggggtttgggacgtggaagctgaaaggtgaggagtgctctcagatggtgaaatatgcgctggacacaggttacacagcgattgatacggcgcaggtttacttaaatgaagaggcggtcggagagggaatccgccgttccggcaggaagagagaagagttctttgtaacttcaaaggtgagaaaccgttttcagggttatgataatactttatatgccgttgaggcgtctcttaagaggtttggtttagaacagctggatctgtttctggttcactggcccggagaggacatgtacgtccctacatggaaagctctggtccgcatgtatgaggaagggctgctccgggcagtgggagcaagcaatttttatccggagcatctggaaacctgtgcccaggaaacaggcgttatgccgttggtagatcagatcgagatgcatccttattttcagccgtacgagatcgttgaatactgcagaagtcatgatatctttccggttgcgtggagtccgcttatggcagggggagagagcagaaaggacgcaaagactgcaaaagccggtgagacaggagtacaattaaaaagcccgatggaagacccggtgattctaaagattgcagagaatcatgaaaagactcctgcacaggtgatcctgcactggcttgtgcaaaatgaattcggtgtgataccgaaatcctcaaatgagggaagaatcaggcagaacatggagatctttgatttccggctgacggatgaagagatgaaacagatgcagaagcttaccgaaaagcagatccgggtgggagacgatccgagaacctaccggttccctcttctggatgagatgatcgcggcagggaaagagccggagagagacagattcggaaattacatgtgacattttcttcatgatttccgttcggctcttagaatgtcttactccaatcatgaagaaaatggacgtaaaataatgtaggcagaaggacggcacagcccgtccttctttttttgagttgttaactgcagactgcgaagtgcagaaatcaaaatcgttaaattgcattcctcaaatatatatgctacattagtggaaaaagagaagaccataaataggaatcacatacatggatataatgaaaataagcggtataaagaaaaaagtattagaagagatcagacaattagcagtggattacaatgttcaaaaagtaatcttgtttggatcgcgtgcccgtggagattatcatgagagaagtgatattgacctggcagtattgggtggagatacaaataactttgcactggcagtggatgaggagacttctacgctgctgatgtatgatatcgtagatttaagtctgccggtacaggaggaactaaaagataggatttatcaggaagggatcgtgatctatgaaaaaatttgaaaacttctgtaaagcgttggacaatcttgaagacatttataaatatgaagaaccctatgacaatgtcgtattgactggactggtggcgctttatgaaatttgttttgaacagtcttggaaggcagtcaaggaagttttatctgaaaatggaatagaagaggcagccacagggtcaccccgcagtattataaaacttgcttatagtgtgaatttaataaaagatcaggaagtctggctggaggctctggtatccggaaacaatgttgctcatgcatataatcaggcgattgccatggatattgtaaagaagaccaaagaacggtatgtcgtcatgtttcgggaactcagatcggaaatcaaagaaaactggttctgatatttgaccgtgtttcttctataatatatgtttttatttttgtttcctgaaaaaaacaaaaaaatcccttgcaatgggaaagaatataagatataatcaaatcgttgtgaccttgatagcggtgaagcgagaggttgctgtaccggcaaaagccggcgcaggttttccgtggagcgaatgtcaagttgttaaaactggcgacaagtcactgtacgaatattacaatctatttttaatatttaaagatagagacgcagtgtgtaaatcttacgatacacacggaggagtgtacagtcaccacttgtcgtgctacaagaaatttatagtgcgaaaaggaggcggctttttttatggcagcaagtcaagtaatgagaattacattaaaagcgtatgatcatcaattaatcgatgcatcagcaaagagtatcatcgaaacagtaaagaaaacaggatctaaggtgagcggaccggtaccgatgccgacaaagaaggaagtagttaccatcatccgtgcagtacacaagtacaaagattccagagaacagttcgagcagagaactcacaagagattgattgacatcatcacaccaacacagaagacagtcgatgcattatctaagttagaagtaccggctggtgtttacatcgatatcaagatgaaaacaaaataggaagttatcccgcagggttatgaacaaataaggaatccccttaagctttcatagcgtctaggatgattttaacgtcaagcgttataatccgctgtagattaaataggaggaaatatcaatgaaaaaagcgattttaacaacaaaagtcggaatgactcagatctttaacgaagacggagttttaacaccggttactgtactgcaggctgggccttgtgtcgttactcaggtaaagacagaagaaaacgatggctacgaagcagttcaggtcggatttgcagataagaaagaaaagtctgtaaacaaaccggagaagggacacttcgacaaagcaggtgttgcacctaaaaaattcgtgagagaattcaaatttgaaaatgcttctgaatacacagtaggtcaggaaatcaaagctgacatttttgaagcaggagataaaatcgatgcaactgctacatccaaaggtaaaggatatgcaggtggtatcaaacgtcacggtttaagtactggtcctaagacacatggttctaagtatcaccgtcatgcaggttccaatggtatggcttctgatccgagcaaagttttcaaagggaagaaaatgccgggacagatgggttctgaaagagttaccatccagaatctggaagtagtaaaggttgatgcagaaaataacattattttggtaaaaggtgctgtaccaggacctaagaaatctttagtaatgttaaaagaatcagtgaaggcgtaggcctagggaaggaggacaatcagatggcagaagtatctgtgttaaacatggaaggaaatgaagttgagaaattaaatcttaacgacggcatcttcggtgttgaaataaatgagcatttagtgcatttggcagttgtaagccagttagcaaataaccgtcagggtacacagagcgcgaagacacgttcagaagtacgcggcggcggaagaaaaccttggagacagaagggtaccggtcatgcaagacagggatctatcagagctccgcagtggacaggcggaggagttgtatttgctccgaaaccgagagaatattctaagaagttaaataagaaggaaagaagattagctctgaaatccgcattaacttccagagtcaatgaaaataagttcatcgtagtagatgagttcaaatttgacgatgtaaagacaaagaatgttgcaaacatgttaaacaacttaaatgtaaaaaaagcgttggttatcatgggagataagaacgacaacttaatcttatccgcaagaaacattcctggagtaaaaactgctctcacaagcaccatcaacgtatatgatatcttaaaatatgataccgttgttgtttctaaagaagcagtagcaaatatcgaggaggtgtacgcataatggcagacatcaaatattatgacgttattttaaagccgattgtaactgaaaaaagtatgaatgcaatggcagagaaaaaatacactttcttagttcatccgactgcaacaaaatctcagattaaagaagcagtggaaaagatgttcgaaggaacaaaggttgccaaagtcaacacaatgaactgcgacggaaagacaaaaagacgtggaatgacttttggaaagaccgctaagacaaagaaagcgatcgtacagttgacagaagaaagcgcagatatcgagatttttgaggggttataggcattgagcacttagagagtgcaagtgaaagcgcagcatgagcttagtgcgaaagccgttaccgagactcagtgaagccgagccgcaggcgaaagctgaacgctagtcgagtgtaactaccttaatatattttattgaatctatacgcaacaaaagcgtgatattaaattggaattgaaaggagaaagacatgggaatcaagacatataacccatatacaccttccagaagacatatgaccgggttagattttacagatgtgacaaagagcacaccggaaaaatctctgacaacttctttaaagaagacagccggccgtaataatcagggtaaaattacagtaagacaccgcggaggcggagtcagaagaaaatatagaattatcgacttcaagagaagaaaagatggtattccggcaacagtaacagctatcgaatacgatccgaacagaacagcaaacatcgcactgctcacatacgcagacggtgaaaaagcttatatcatcgctccgaacaaattagctgtaggtgctacagttatgaacggtccggacgctgagatcaaagttggaaactgcttaccgatggcaaacatcccggtaggtacagaaattcacaatatcgaaatgtatcctggaaaaggcggacagttagttcgttccgcaggtaactccgctcagcttatggcgaaagaaggaaagtatgcaacccttcgtcttccgtcaggagagatgagaatggttcctgttgtgtgcagagctacgatcggccaggttggaaacatcgaacatgacctcgtaaacatcggtaaagcgggacgtaaacgccatatgggattccgtcctacagtccgcggttctgttatgaaccctaatgaccatccgcacggtggtggtgaaggtaagactggtatcggccgtccgggtccatgtacaccttggggtaaaccggcacttggtttgaagacacgcaagaaacacaaacagtctaacaagatgatcattagaagaagagacggtaaaaacgttaaatagtttaaggaggtaacttatggctcgctcactgaaaaaaggaccatttgcggatgcaagcttattgaaaaaagttgatgcaatgaacgaagctggagacaaaaatgtcatcaagacatggtcccgccgttccacaatcttcccatcctttgtagggcatacaattgccgtacatgacggaaggaagcatgtgcctgtatatataacagaagatatggttggacacaaactcggagagtttgttgcgaccagaacattccgtggtcatacaaaagcagaaaagaaatcaggaatcagataatcgatagaggaacggaaggaggtttcacaatccatggctaagaaatacagcagatctcagtacaaaaaagaaagaaatgcacaaaaagatacgagacccagcgctaccttatccaatgccagagtgtctgttactaaggcatgtttcgtattggatgcgatcagaggaaagagcgttcaggaagcacttggtatcttattatataacccaagatacgcatctagtttaatcgaaaaattattaaagtctgcaattgccaatgcagaaaataataatggaatgaatccggaaaacctttatgttgcagagtgttatgcaaacaagggaccaacaatgaaaagagttaaacctcgggcacagggaagggcatacagaatcgaacaccgtatgagccatatcactgttgtgcttgacgaaagatagaaggaggcaataatgggacagaaagttaatcctcatggtttaagagttggtattatcaaagactgggattccagatggtatgcagaaggcaattttgcagataacctggttgaagatgataagatcagaaaatatgtaaagaaaaaattatacaatgcaggaatctccagaatcgaaatcgagagagcttccgacagagtaaaattgatcgtttatacagcaaaacctggagtagtgatcggaaaaggcggatctgccattgaagaactgaaaaaagaactccagaagatgacagacaagaagctgttaatcgacgtaaaagaagtaaaaagaccggacaaagacgcacagttagttgcagaaaatatcgcacagcagttagagaaccgtatctctttcagaagagctatgaagtcctgcatgcagagaacgatgagatccggagcacagggaattaaaacatccgtttcaggacgtttaggcggagctgatatggcccgtacagaattctacagcgagggaacaattcctctgcagacactccgtgcagacatcgattatggatttgctgaagcagacacaacttatggtaaagtcggagttaagacttggatttaccatggtgaagttcttccgacgaaagaaaagcaggaagggggaaataaataatgttaatgcctaagagagtaaaacgccgtaaacagttccgcggaagcatgcgcggaaaagcgactcgcggtaataaaatcacttacggagaattcggtatcgtggcaacagagccggcttggatcagatccaaccagatcgaggcagcccgtgtcgctatgacccgttacatcaagcgtggtggtaaggtttggattaagattttccctgataagccagtgacagcacagcctgctgaaactcgaatgggtaaaggtaaaggtaacttggaatactgggtagcagttgtaaaaccaggacgcgttatgtttgagatttctggtgtaagtgaagaagttgcaagagaagctttacgtcttgctgttcataaactacctgttaagtgtaaaattgtttctcgtgaagctttagaaggcggtgacaacagtgaaaactaaagaatttgtaaaagagttaaataataaatctattgatgaattaaacaaagagctagtagctgcgaaaaaagaattattcaacttgagattccagaatgcaacaaatcaacttgagaacacaagcagaatcaaagaagttagaagaaacatcgctcgtatccagggagcgattacagcaaaggctaacgcttaaatcgaaaggaggaatttgttgtggaaagaaatttgagaaaaacccgtgtcgggaaagttgtaagcgacaagatggataagacaatcgtagttgcaatcgaagataatgtaaaacatccattatataagaaaatcgtgaagagaacttacaagttaaaagctcatgatgaaaataatgaatgccgtatcggagacagagttaaagttatggaaacaagacctctctctaaggacaagagatggagacttgtggaagtagtcgaaaaagcgaaataggattgttccattaggaaaggagaaacagcatgattcaacaggagtcaagacttagagtggctgacaacactggagcaaaagaaatcctttgcatcagagtgttaggtggatccactagaagatatgctaacatcggcgatattattgtagctacggtcaaagatgcaacaccaggtggcgttgtaaaaaaaggtgatgtagtaagagccgttgttgttcgtacgaaaaaaggtgcccgccgtaaagacggatcttatattagatttgatgagaacgctgcagttattatcaaagaggatatgaacccgagaggaactcgtatctttggaccagtggcaagagagctcagagacaaaaaattcatgaagattgtttcattagcaccagaagtattataaggaggaaacactgtgtcaggaattagaattaaaaaaggcgatcttgtaaaagtcatcgctggaaaagataagggtaaagaaggcaaagttgttgcaatcgaccacaagaagaatactgtcatcgttgaaggtgctaatatgcttactaaacataccaaaccaagcgtacagaaccagcagggcggtattgtgacagaagaaggcccgatccatatttccaacgtaatgttcgttcataacggaaaagctacaaagatcggctacaaagtagaagacggtaaaaaagtccgtgttgcaaaggcaaccggagatgtgattgattaataaagagaggaggtttcggacagttgagtagattaaaagaacagtataccaacgaaatcatggaagccatgatgaagaaattcggatataaaaatattatgcaggtaccaaagctcgagaagatcgtgatcaacatgggcgttggtgaagcaaaagaaaataaaaagctcttagatgctgctgttgcagatatggaaacgatctccggacagaaagcgatcgtaaccaaggcaagaaaatctgttgctaacttcaagttaagagaaggaatgccgatcggatgcaaggttacattaagaggcgagagaatgtacgagtttgctgatcgtctgatcaacctggcactgcctcgtgtacgtgacttcaggggtgtaagccagaactcttttgatggaagaggaaactacgcattaggaatcaaagaacagttaattttcccggaaattgaatacgacaaagtggataaagtcagaggtatggatgtgattttcgttacaacagccaacacagacgaagaagctcgtgaattattaactttatttggtatgccgtttaagaaatagttaggagggttcccatggctagaaagtcaatggtattaaagcaacagagaaaacagaagttttcaacaagagaatatagccgttgtaggatttgtggacgtccacatgcttacttgagaaaatacggaatctgcagaatctgcttccgtgagttagcgtacaaaggacagattccaggcgtgaaaaaggccagctggtaagaatagggaaggaggaacaaacaatgacaatgagcgatccgattgcagatatgcttacaagaatccgtaatgcaaacactgcgaaacatgataccgtagaaattcctgcttctaagatgaaggttgcgattgctgaaatccttttaaaagaaggtttcatcaaagcattcgacattaaagaagaaggtgcatataacaacatcgttatcacattaaagtacggccaggataagagtgaaaagatcattacaggtcttaagagaatctctaaaccaggactccgtgtatatgccaactcagaagaacttcctaaagtattaggcggacttggagtggcaatcatttcaacaaacaaaggtgttcttacagacaaagaagcaagaaaagaacacgtaggcggagaagtacttgcgtttgtatggtgacctagagcacttagcgaagtcaagcgtcagcgcagactgaggttagtgtgaaggtcgttcggaggaacttaatgagggcgagctgcaggcgaaggccgaatttagtgaaccgaacttccttacaaaaggcttgcgtaagcttcaaacaaattttttaacttgaatttatcttattgttaaactttatactatataataaaacgaattctgaaaacagaaaggacgcccagtcctttccgacaatttaaggaggtaacctatgtctcgtataggtagattgccaatcgatatccctcagggagttgaggttaagattgaagaaggaaacaaagtgactgtaaaaggtcctaaaggaacactggaaaagaatcttccggtggaaatggaaattaaattagaagacaaccagatcgtggtatccagaccgaatgacttaaagaagatgaaatccttacacgggttgaccagatctttgatcgccaacatggtgactggagtgtctcagggatatgaaaagaagcttgaaatcaacggtgttggttacagagcacagaaaaaaggaaaagaaatcactttcaaccttggattttcacatccggtagcaatgacagatccagaaggcatcgaaactgaaatggacggtcagaatatcattatcgttaaaggtattgataaagaaaaagttggacagtacgctgcggaaatcagagaattaagaaaacctgagccttacaaaggaaaaggtattaaatatgctgatgaagttatcagacgtaaagtcggtaagactggtgcgaagtaaaggagtgagataggatgattaaaaaacagtcaagaagcaaagttcgtgcgaaaaaacatttaaagcttcgtaatcatattagcggaacagcggagaaaccgcgtttaagcgtattcagaagcaataatcatatgtacgctcagatcattgatgacaccgttggaaatactttagtatcagcatccactttacagaaagacgtaaaagctgatttggagaagactgacgatgtaaaagcggcagctcacttaggaaaagtgattgctgagagagcagttgcaaaaggtatctccaccgttgtttttgacagaggcggatttatttatcagggaaaagtaaaagcattagcagacgcagcacgtgaagctggtcttaaattctaacaggaggaaatcaaatgaagcgtacaatgatcgaccctagccagttagagctggaagaaaaagttgtatctatcaaacgtgttaccaaagtagtaaaaggtggacgtaatttcagattcgcagcattagttgttgttggagataagaacggacacgttggtgcaggattaggaaaagcaatggaaattccagaagcgatccgcaaaggaagagaagcggctgctaagaaattagtggaagtaccgattgacgaaaaaggaagtacaccgcatgattttacaggtaaattcggaagtgcgtctgtattattaaagacatctccggaaggtaccggaatcatcgcaggaggaccttcccgtgacgtattggagcttgcaggatacaagaatatccgttctaaatctttaggatccaacaacaagcagaacgttgttctcgctacgatcgaaggacttaaaaacttaaaaactccagaagaagtagcaaagcttcgcggaaaatctgtagaagagctcttaggttaggaggaacatgaaaatggcagataaattaaaaattactttagtaaaatctacaatcggtgccattccaaagcatagaaaaacagtggaagctttaggactcaagaagttaaacaaaactgttgaaatgccggataatgcaagtgtcaggggaatgattcatcaggttcagcatttagtaaaagtagaagaaatttaattgtagattaggaggtgcgaaggatggaattatcaaacttacgccctgcagacggatctaagcacagcgacaacttcagaagaggtcgcggacatggttcaggaaatggaaaaactgcaggtaaaggacataaaggacagaaagcccgttccggcggcggagtaagaccgggatttgaaggcggacagatgcctttatacagacgtattccaaagagaggcttcacttgcattaactctaaagaaatcattggaatcaacgtatcagcattagaaagatttgaagacggagccgaagtttctgttgagactttagtagaagcgggaatcgtttctaatccgaaagacggagtcaaaatcttaggcagtggagaactcacaaagaaacttacagtaaaagcaaatgctttcagtgcaggggcaaaagaaaagatcgaagctcttggaggaaaagccgaggtgatttagtatggcgaatgcattgacaaatgcgtttaaaaacaaagaactaaggaaaaagcttgcgtttacggtgatcattctgatcgtcgtgcgcttcgggtcacaactgccgattccaggaatcgatactgcccaggtgactgcatatttaaagagtacattgggagattcattcaatctcctgaactcttttaccggcgggtcctttttgcagatgtctgtatttgcactgagtgttacgccatatattacatcttccatcatcatgcagctgatgacgatcgctatccctgcattggaggagatgcagaaagacggcgaagatggaagaaagaaaatagctaagattacgagatacgttacggttgtattaggactcattgagtccgccggtatgaccataggtttcagccgcagcggtgcgctgggaccggaacacacaaattttaccattgtaacgatgatcattgccctgacagcgggtgcgatcctcgttatgtggcttggtgagcgtatcacggaaaatggtattggaaacggtatttctatcatcctgttgatcaacatcgtatcaggaatgccgaaagatttttatgcgctctataatcagtttatgaaaggcaaacagatcggaccggcactgattgccggatgtgtgatcgcagccgttgtgctgttcactgtcgtgttcgttatcattctttcagacgctgaacgccatattccggtacagtattcaaaaaaagttcagggaaggaaaatggtcggcggccagtcaagccatattccgctgaaagtgaatacagccggagttatcccgattatcttcgcctcatctatcatgcagttcccgctgattattcagcagctgtttaagtatgagagcaatggatttatgggaaaggttctgcacagtttaagttcgtccacatggtttgacgcaaatcatccgaagagatcgctgggtcttcttatatatattgtacttgttgttatttttgcatatttctatacatcgattacttttaatcctctggaaatttcaaataacatgaagaaacagggaggatttgtaccgggtatccgtccgggcaaaccgacagtagattatttaaacaagatcttaaaatatattatttttataggtgcagctggactaacaattgtagcagtcattccgtttttctttaacggtgtatttagtgctcaggtttcttttggcggaacttctatcatcatcgtggttggagtcatattagagacgatcaagcagattaaatctcaattgttagtgcaaaactatactggttttttaaatgactaatgtgcgataagctgtagggaattctacagcttatttgtgcattacataatgtaaggaggattcattatgaagattattatgttgggggctccaggagcaggaaagggaactcaggcaaagcagattgcagagcagtataacattccgcatatttcgaccggtgacattttcagggcgaatatcaagaatggaaccgagcttggcaaaaaagccaaagagtatatggaccagggactgctggttccggatgagctggtagttgatcttgtggttgacaggattgagaaagacgactgccaaaagggcttcattttagatggattcccaaggacgattcctcaggcagaagcgttggatgcggctctcgccgcaaaagatatgaaaattgattatgcgctggatatcgaggttcccgatgagaatatcatcgaccggatgtccggaagacgttcctgcagggaatgcggtgcgatcttccacgcaaaatataatcctccgaaatcagaaggaatctgtgatatatgcagcggcgagctgatcctccgagatgacgacaaggaagagacagtgaagaaaaggctggatgtttatcacgaacagaccgcaccgctgatttctcactataagagtgcaggcagcctgcatgagatcgacggcacaaggcacattgatgtagtatttgatgagatcaaaagcattttagaggcataagattaacatggcagtgacgatcaaatcaaaaaaagaaatcgaacaaatgagagaggccggtaagatcttggaagagacgcatgaccgtttggccgagatcatcaaaccgggaatttctactttagagattgaccagttcggggaaaagatcataagggaatacgggtgtattccttcttttctgaattacaatggttacccggcatccatctgtgtgtctgtcaatgacgaagtggtccacggcatcccaaagaaggagcggattttaaaggacggagatattgtcagcctggatgcaggggtcatctatcagggataccactctgacgccgccaggacctatggcgtcggggagatctcagaggaagcagcccgcctgatcagggtcacaaaggaaagcttttttgaaggtatgaagtttgccaaagaagggaatcatctatttgacatttccgaggcaattcagagatacgtagagaataatggctattctgtggtgagagacctggtgggccatgggatcggaactcatctccatgaggacccccagatcccaaacttcaaggaacgaagaaaaggcatgaagctcagggcaggaatgacactggctgtagaaccgatggtgaacgccggaacatggaaagtggaatggctttctgatgactggaccgttgtaacggcagacggaagccttgccgcccattatgaaaatacaatcttaataaccgaagatggttacgaattattatcattatcaaagtagaaaaaggagtcggaaaaatggcaaagtcagaagcaattgaagtagaaggaatcgtattggagaaactgccgaatgcgatgtttaaggtagagatcgagggaggacatgtgattttggcacatatcagcggaaagctcagaatgaattacatcaagatccttccgggtgacaaggttactcttgcactttctccgtatgacctgtcaaagggaagaattatttggagagataaataagaaaagccttgaaaatcagatagcatgatgatataattgaatccgaacgttttgagaaaggagaattacaagtgaaagttagagcatctgtaaaacctatgtgtgaaaaatgcaaggtaattagaagaaaaggttctgtcagagtgatctgtgagaatccgaagcacaaacagagacagggataatttctatttcacgtagcaaggattcctatctttgttctttgtgtgtttatattactgtatccaaggtaccatacagtaatactttttgttaggcggctgcagtatggaacgcagattccatgctgatatttatatagataaaatcgtagtcaggctagagacatatatatcatttcaccgtacgcggatatatggattgcccctgaacaacattaaaatgaataatttttggaggaagaaaaaacatggctcgtatttcaggtgttgatttaccaagagaaaaacgtgtggagattggacttacctatatttatggaatcggtcttacaagctctaaacgtattttatcagaagcaaatgtaaacccggatactcgtgtacgtgacctgacagatgatgaagttcgcagaatcagcgaagttatctctgagtcacagacagtagagggagacttaagaagagaaatcgctcttaatatcaagagattaaaagaaataggatcttacagaggaaaacgccatagacagggactgccttgccgtggacagaagacaaagacaaatgccagaacatgtaaaggtcctaagaaaactgttgcaaacaagaaaaaataacagcttacacatgggccatcagatctttgatggtatactttggacggaaacacatgacacgccccgttgggttgtcaggttttctggctgtttagtggatatggtttagtttaaagaaaggtaaagagttaattatggctaaagttacaaaaaaagcggctaaaaaacgtgtgaaaaagaatgttcagcacggacaggcacacattcagtcatcttttaataatacaatcgttacattaactgatgctcagggaaatgctctttcttgggccagtgcaggtggattaggattcagaggatccaaaaaatctactccttatgcggcacagatggctgctgagacagcgacaaaagcagcattagtacacggtttgaaaacagtggacgttatggtgaaaggaccgggatcaggaagagaagcagcaattcgtgctttatcagctgctggtctggaagttacaagcatcaaagatgtaacaccggtacctcacaatggatgtcgcccaccaaaacgcagaagagtttaatttaggaggaatttgaaagatggcaattgacagaactccagtcttaaaaagatgtagatccttaggcctcgatcctgtatttttaggaatcgacaaaaagtctaacagaacctcaacaagaggaaatagaaaaaagagtgagtacggacttcagctccgtgaaaaacagaaagcgaagtttatctacggtgtattagaaaaaccgttcagaaattactacgcaaaagcagaaaaaatgaaaggtcagacaggtgtaaaccttatgacacttctggaactgagacttgacaatgtattattccgtctcggattcggaagaacaagaaaagaatgcagacagatcgttgaccacaagcatgtgcttgtaaacggcaaaactgtcaacatcccttcttacagagtatcagtaggtgatgtgattgagatcaaagaaaaccacaaaacttctcctagatacaaagaaatcttagaagtaaccggcggaagaatggttccttcttggttagaagcaaaccaggaagcactgagcggaactgtaaaggaattacctgcaagagaagagatcgacgttcctgtaaatgagacactgatcgtcgagttatattctaaataatcgtaataaccctcaacaaattcctaacccagaaggagggcttaaatgtttgaatttgaaaagccaaatattgagattagtgagatttctgaagataaccgtttcgggcgttttgtagtcgagccgttagtgcgcggctacggaacgacactcggaaattccttaaggaggatcatgctctcatctctgccgggcgctgcagtcagtgctgtaaagatcaaaggtgtactgcatgagttcagttccgttccgggagtgaaagaggatgtccctgagatcatcatgaacatcaagtccctggcgattaagaataacagttctacggacgaaccaaaacaggcctttattgagtgctccggaagcggtgtcgtgactgccggtgacatcaaggctgacagtgatatcgagattttaaatcctgatatggtcatcgcgacattgagcggagatgacgcacatctggatatggaacttacgatcacaaaaggccgcggttatgtcggtgccgacaaagcagacaaggaaggcaactctatcgatgagattgcagtcgatgcaatctatactccggtagagcgtgtgaatctaaaggtggaaaatacccgtgtgggacaggtgacagactacgataaacttactttggatgtctttacaaacggaaccctttcaccggacgaggcggtcagcctcgctgccaaagtattgtgcgaacatctgaacctgttcgtagatctctccgagaatgccaagacagcagaagtcatggttgaaaaggaagatgacgagaaagaaaaggttctggagatgagcattgatgaactggaattatccgttcgctcttataactgcctgaagagagcaggaatcaatactgtggaagaactgaccaacaagacttcagaagatatgatgaaggtccgcaacttaggacgtaaatcattggaagaagttctagcgaaattaaatgaacttggattggcattaaattcaggggatgaataagaaatcataaaaagacccgcctaggctgaaggtatgaagtaagcatggcgaaaaatcacaggaggtcattataatggcaaagtacagaaaattaggaagaacatcttctcagagaaaagcattactgcgttcacaggtaacagatcttttatacagaggcaagattgttacgactgaagcaaaggcaaaagagatccgcaagatcgctgagaaactgattgcaatggcagtcagagaaaaagacaactttgagacagtcactgttgacgctaaagtagcaaagaaagacagcgacggaaaacgtgtcaaagaagttgttgacggaaagaaagttactgtatacgagacagtgaaaaaagagatcacaaaggatatgccttcccgtcttcatgcaagaagacagatgttaaaggtattatacccggtgaaggaagttccgacagagcttgcaggcaaaaaagccaatacaaagactgttgatcttacagaaaagttatttaacgaatatgcaccgaagtatgccgatagaaatggtgggtatacaaggatcgtaaagatcgcacagcgtaaaggtgacggtgccttagaagtattgatcgaattagtataataagagccatattttgaaaaagaagcagattttatcctgcttctttttttgccatgaattttgggccggagacgctttctctgaatgctcagcaccatcacagaaaaaccggatgaaatcatgtaaatataatttcatccggtttttgaattgcttttttataagcctgtgcgttttttaagcaggaagctgccacagatcaggcttccggaaaggattagaagaagagaagggaaactgcggtgtgtatcggctgtattggccgtactgccgacgtagccctgtcctttggaatctgatttagagatttttttattggacgcggttttttgtacaatgtcttttttccctatagcagttttgctgcgggaagtgttctttttatcagaggtattcttatctcccccggcagaagttgtattgacagcagactctgaggctgctgaagcctggtccttatatacaagggtataaacagaaaaccggtcagtttcgacagttaccttgtcaggctctgtacttaaattattcagagtgtcagcgctgtagcttccgtcagattcttcatgaatgcggataacctgaaactgtctgttttcttttcggtattcctcaggtacatcgaaggtaagttttaatggtgaggttaaagtatgaatactttccggcacatcgtcaatgaccttcatgagattgagatccaagatgaccgcaggctgagtctgggtgcggtccatttccttctccaggagtttgctgatatctgtaggcggatcagatacgggagaagaattcaggacaatttctatactgcttccggtgtttattttttcccggtcttcctgcgtcagaaaatggcctgcatcgctgttttccaaggccactccaggggcttccgggggctgctgtacggcgatggagccggaaggtgtattataggacgcgatcttccagaccgcagattccgctgtttcattgtagtttaaagttccgtttctcagtgcaaaccaattttgttctgcaccgctgccatggaacgtcactgcagtttttccggctgaaagtcctgtaacttttaaaagtgtcgggacaccgtcagattttggttcaaaggaactgaccgtaatcggatggcttactgataaagtatcaaaatgagcaataccgtcaaaagttgatgcgctgtcttttatgataagatcagatcctgttttgcaggacagggaatttcccttgagcaaaaggcctccccagagaaattctgttttactgttagtgacggtcatagcggcctgtgaggactctgcaagactcctggaactctcgtcatccacctccccgactaagatgtagtcgccgtagtacatggttcctttatattcgtttccctttacattttcgagggaaaaagaaatttttccggatctggcagaacctccgctgacggattctccgcctcccacaatcgtgcctacgatttcactgtctttgtaaagtgtagagcaggtaccttttacatctgcgctggagccctgacctgaagcctgaccgccggtgtgaaaagcggcagccaccagattaccccactgctctcctaccggagacacagaattgactacattcagggaaacagaaccgtttacatcggcagaacctccgccggaggctgtacctcctgccgtgacatagccatatatattggaacagttgctcagattggcagtgatactgccggaaacatcggcgcaggcctgattgctcgcatccccgccgccgtggaagatcatgacttcatttccgcttcctgcaaaggaagaggtgatggagccgcagcttgcatgagcgttggctccgctggcataaccgcccgaatatacttcacggatgtctacacttttcattgtacaggaaacagaaccagatacatctgcagaggctttaccgtccccgtttgctgtggcatagccgcctccgcgcagagaatatgtcctgctcgtgacacttatgtttactgaggctacatccgctgaggcattatatgctccggtggtatacgcatagccgcctccgtataggttgccatggttgctggacgggacagagggaatgtcaacagtgacagatccggatacattggcactggcatttcccttggatgcattggcatatcctcctccacacactgaagaagcattcacagtacctgagactttaatggagacatttccactcagatccgcatttccggtaccatcggaaaaacctcctccatatattctggacacctgtacattttggatgtcaatcgttacatttccttttgcgggtttattctttcctccgccatagattgtaaaaccgctcgtaaccggtgtgtcagacagacgggaattaccggaggcatcaaagacataggctttgccgtcggaatccttcttgatcacgatggaagtgccctgagcatagagtgtactgccttcgatcatgatttcctgatcacttgcagcagtttttttcattttcacgtctttttcagatactccttcattggaaattttggctgcagctgagttttgggcttctgtcgtctctttctttgaggtctcggtaacctctggttcaggtgctgtagttgtctgctgactttcggctgtctctgtcggcctgtcagcagatgcaggtttttcttcctcagatgcagccacattctctgaagaggatgccgcctgaaggtccttctttgcttccagtggttcctccgccgcataacttaagttgcccagagttgcaaggccgagtgcaagaaatattgcggtcagccacgcagcaggctttttcaagcgtttcatagtaatctcccccttatttgatatgttgtcatgatactaaaataaaaaactccggcggtatcctgccggagtcgattttatcttaaaaaatgcaacgtaagtcaaactgcatagaaaatatgcagtacaaaatccatcgagagggctatgaaagtacaatagtcccgtaggtaaaatggagcaaccggctgccgtaccagtaaatggtttaggcccttggctttgcgtcaccggatttccccggttttgccaaaatataaagaccgttttaagcggtgcttatttctaccctaagtatatggtctaaccgtgggaatgtcaatgaatacctattgtttccagagaattttattgatataatggagcatatgtcaaaggagaaaccaatgtcaatattacagatcaaagatttaattcatcaatatataacgtatggggagaaggaagaggaaactcagacaataaatgccgtaaatggtgtggatatgtcggtggaaaaaggggagttcattgccattcttggacacaacggctccggcaaatcttccctggcaaaacatatcaacggactgctgcagcccacatccggctctgtctgtttaaagggtatggatacaagagaccatgaaaagctcctgaagatccgccaaagtgcaggaattgtatttcaaaacccggacaaccagattgtcggttctgtagtagaagaagatgtagccttcggcccggaaaatatcggcgttcccacaaaagacatctggagccgcgtggcaggggcactggagggcgtcggaatgaccgcttaccgcagtgcaagccccaaccatttatccggcggacagaaacagcgcatagccattgcagggatcatggctatggaaccggagtgtattatcttggacgagcccaccgcgatgctggatcctaagggaaggcaggatgttttgtccctgtccagggaactaaacaaagaaaaagagatcacgatcattttaatcacacatgatatggaagaggtactgttggctgacaaagtgtttgtcatggatcagggaaaggtcgtaatgagcggaacgccaaaggaagtgtttgcccatgttaaggagctgaaagggtacgggcttgaagttccgtttgccacagagcttgcttacgagcttaaaaaggagggtatcaggctttctgatgcgataacgacaagggaagaactggtggaagagttatgtcaattagtttagaaaaagtaagttatatatatgaagataattcggatataaagaagcccgcgctgatcgatatagatttagagatcggagagggagaatttatcggcatcatcggacacacgggatcgggtaagtctacgctgatccagcatctgaacggtctcatggaacctacaaaaggaagggtgtattttgagggaaagaatatccacgatgacaattatgatatcaagagcctccggggaaaggtcggcctgtgttttcagtatccggaacaccagctgtttgagacaaccatactggaggatgtctgtttcggccctatgaactttggggcatccaaagaagaagctgtcaaagccgcgaaggaggcactcaaagacgtggggatctcagaagaactgttcggaaagtcgccgtttgaactgtccggaggacagaagcgcagagtagctatcgcaggcattctggcaatgaagcctgaatattttattctggatgaaccgaccgccggtctggaccctgagggaagggtacagcttttagaactgctgaagcgtctcaatcaggaacagggtatcacgatcatacttgtatcccacagtatggaagacattgcatcctatgtagacaggatgatcgtcatgaaccgtgggcggctggaatttgacggggataaggaagaggtgttttcccatcaggaagaactggagcagatgggactgtccgtaccgtttttcagactcctggccaatgatctgaaagaaaaaggatttcctgttgagggagagatcctgacccttgaagatgccaggagggcaatcctaaaaacattaaagaaggaacaaacatatgattaaagacatcaccataggacaatattacagatcagattctattcttcaccggctggacccgagggtaaagctggtggggacattgatttttgtcataaccttgtttttctcaaagtccccgctgacttatgcggcttctctgctgtttttggctttgatgatcggcctttccactgtacctctttcttttattgtcagggggctgaaagccgttggcgttattttgcttttctccgttgtcatcaatattttcttcataccgggggaggcgatcgtacatttcggtgttatcaggatcaccaaagaaggagtcatcacagccgtttatctgggcacaaggctggtgatgcttgtattgggcacttcccttatgacctttactaccacacccaatgagctcacagacgggctcgaaaagtccctgggatttttgaagctgatcaaaattcctgtgcatgagattgcgatgatgatgtcgattgccctaaggtttatcccgatcctcacagaggagctggacaagatcatgaaggcccagactgcaaggggagtggattttaaaaatggaagttttctgcaccggatgaagagcatggtgccgatcgtagtgccgctgtttgtggcggcggtaaggagagccaatgacctggccctggccatggaatccaggtgctaccacggaggggacggacggacgaagatgaagcctctcaaatactgcagaagagacctgctggcctatctgtttttggctttgtttttggcactgatgatttacctgggatttttctgtccggtcggaagataggcgtgaggtattctatgaaacggataaaattagaagtggcatatgacgggacaaattactgcggctggcagatacagccaaaggatacgaccatagaagggattctcaatgagaagcttggcagtcttttgggagaagagattacggtgatcggtgccagccgcaccgactccggggtacatgccctcgggaatgtggcagtttttgacacggagacggagattccgggtgaaaggatcgccagggctctgaaccagaggctgccggatgatattgtcatacagtcttccagtgaagtaaaagacgatttccatcccagatatcaggatacgaggaaaacttacgagtatacgatttacaatgcagaatttgataacccggtcacggcaaggcaccatcacttcgtgtatgtgccgctggatgcggagcgtatgcgcacagctgcccgctgctttttaggtgagcatgactttttaagcttttctaccacagggagtcctacaaagaccacggtgcgcacgatctatgagtgcgaagtgaggcagaacggccggtatattaccatgagagtcacgggaaacggatttttatataacatggtgcggatgatggcaggaactctaatctccatcggaaggggcaggaaggatccggagtgggtcagggaacttttcctgcatccgaagagaggaaaggcaggtccaaatgctccggcaaaaggactgacactcatcaacatacattacatggatgaagaaaaggaagcggattagatgaagattatgggactgcaaaagtcaacactcctggattatccgggaaaagtcgcctgcacggtatttaccggcgggtgtaattttttttgcccgttctgccacaatgctgagctgatctctccgcggaaggaggagccggggcttttagaaaaagatttgctggcctttttaaggaagcggagaggaatcctggacggagtctgtatttccggaggagaaccgctgcttcacaccggactttcagggcttatcagagagatgaaggaactcggctatctggtgaagctggataccaacggaagctttccggaaaggctcaaaaggctggtcggagagggccttttggactatgtggccatggacataaaaaattccaaaaagaaatatgctgccacggcgggagtggaagcatttcagatagaaccggtggaggagagcgtcagattcctcatggaaggaaatgtaccgtttgagtttcgtaccacggtggtgagggaacttcacagcggggaggatatcgaagagatcggagagtggatttccggagatgaaccatatttccttcagagttttgaaccctctgatcatgtaccggatttgagactcagtgcctatgggaaggaagaaatggagacactggcggatattttgagagaaaaagtgccgaatgtagaattaaggggattataacaatatattgtgcctgtatagataaaaacatacaatatgttgactttgttttatatggtgctataattttaagtgttgaacatatagaaagaatggggtgtgtgagtcatgtattatgtaataaagagagacggaaccaaggcagaatttgatatccagaagatatccactgccatcacaagggcatttgaagccaaagaaaaacagtatcatccgagtgtgatcgatctgctggcgcttaaagtcacatcagattttgagccgaaagtaaaaaatgatgtgatcgcggttgaagacattcaggacagcgtggagtctgtgctgatccaggcaggctatgccgatgtggcaaaaggatatattttatacagaaaacagagagaaaagatccggaatatgaagtctacaattctggattataaagagctggtggacagttatgtgaaagccagtgactggagggtaaaagaaaactctaccgtgacatattccgtcgggggactgattttaagcaacagcggggccatcacggcgaattattggctttccgagatctatgatgatgagattgccgatgcccacaggaatgcggacattcatatccacgacctttctatgctgaccggttactgcgcgggctggtctttaaagcagctgatccaggaggggctgggaggcgtgcgaggtaagattacctccgcaccggcgaagcatttgtccacactgtgcaatcagatggtcaatttccttggcatcatgcagaatgagtgggccggagcccaggcattctcctcttttgatacatatcttgcaccgtttgtaaaggcagacaatctgtcctactatgaagtgaaaaaatgtgtgcagtcctttattttcggtgttaatattccgagccgatggggcacccaggctcctttttctaatattactttggactggaccgtgccggatgatctggcggagctccctgcgatcgttggcggcaaagagatggacttccggtataaagactgcaaaaaagagatggacatggtgaacaaggcctttatcgaagtcatgatcgaaggggatgccgaaggacggggcttccagtatccgatccctacctattctattacaaaagactttgactggtctgacacggaaaataaccggcttctgtttgaaatgaccgccaaatacggaactccgtatttttctaattatattaacagtgaaatgcagccgagtgatgtgcgcagtatgtgctgtcgtctgcgcctggatttaagagaactgcgtaaaaaagcagggggatttttcggcagcggagagagcaccggatctgtaggagtggttacgatcaatctgcctaagattgcttacctttctaaagatgaaaaagatttctatcacaggctggatcatttgatggatgtgtcagcacgatccttaaagataaaaagaacgatcatcacgaaattgttcgatgagggactgtatccttatacgaaacgttatttggattcttttaacaatcacttttctaccatcgggctgatcggaatgaatgaagcgggcctcaatgccggctggatcaaggcggatctgaccgaagaaaaggcacaggaatttgctaaggaagtattgaatcatatgagaaaccgcctgtcagattaccaggaagaatacggtgacctttataatcttgaggcgactccggccgaatctacgacataccgcttggcaaagcatgacgtggcagagttcccggacatcatcacggcttctgaggatggaggaacaccattctacacaaacagttctcatctgcctgtgggatatacggacgatgttttcgatgcgctggatattcaggatgaattacagacattatatacatcagggaccgttttccacacattcctcggagagaaacttccggattggaaagcggccgcggctctggtgaaaaagatcgcagaaaattaccgccttccatattatacgatttcaccgacctattctgtatgcagcaatcacggttatataaacggggaggtttatgaatgtccggactgcggggagaagacagaagtgtacagcaggattacgggctactaccggccggtccagaactggaacgatggaaaacagcaggaatataaagaaaggaaactgtacgatcccaaaaattctgttctgaaagcatccaagactccgaaaaaagacataagctttgcctcagaggcggaaaagaagatggaagaagcccagaaaatgcttctgtttacaaccaaaacttgtccgaactgtaagatggccggagaggtccttaaaagttcccggattccatttgaaatcgtggatgccgaggaacatcaggaattggtgcaggaatacggtattatgcaggctccgtctctggtcgtactgcgtggggacgaattcgagacgcactgtaatgtttccaatattaagaagtatgcagaacaaaatcattgcggctgatcacagggtatgtccaattttgtttcataatttttggagaaaatttattgacacaccccggtcagtgttatataatatgaaaatgtgacataaaagaaaatgcttaccccaatgccccggagggagtattttatatagaagacacattgattgagaaatttaggaggaagaaccatgaagagctttatggcaagcccatcaacaattgaaagagaatggtatgtagttgacgccacaggacatacattaggacgtttagcatcagagatcgcaaaagttttaagaggaaagaataagccgacttatactcctcacatcgacacaggcgataacgtgatcgttgtgaatgcagataaaatccaggtaactggaaagaaattagaccagaagatctactacaatcactctgattatgtaggcggaatgaaagagacgactttaaaagaaaaaatggcgaaaaagcctgaagatgttatttatcttgcagtaaaaggtatgcttccaaaaggtcctttgggaagagcaatgattaagaaacttcacgtatatgcaggcgcagagcacaacaatcaggctcagcagccaaaagcattagagatcaagtattaagaaggaggacgattaagtggctacagcaaaatattacggaactggtagaagaaaaagcagtatcgctagagtatatttagtaccaggaacaggaaaaatcacaatcaataaaagagatatcgacgaatatttaggattagagacattaaaagtagtcgtacgccagccattggttgctactgacactctcggaaaatacgatgttttagttaatgttatcggcggtggttttacaggacaggcaggagcaatccgccacggtatttccagagctttattacaggttgacggagacttccgtccggtattaaagaaagcaggatacttaaccagagatccacgtatgaaggaaagaaagaaaccgggacttcgttctgcacgtcgtgcaccacagttctccaaacgttaatttcagttacgcaagagataatcttcggaactcggatttacgttcaaatccttgttttgcaagggtttgtggagttgtcagatgtggtggaaagcggtggaatttactcagttcgcaacgcatttgcaacacgtttgcaacaaaaatatctaaagaatataggacacttttcggtgatagacactggagagtgtcctttttgttatgcagattttgtatcggcagttacgatgtcctcattttctaaggttttgttgattgcgtctacgagaacctgcatatctaagtgagtataaactttttctgtcagagtcatagcaccggagtgccccacaattttcttgattgttgtatcctgaacaccagcttccgataacatggaaatacaggtatgtcgagtacaatgcggtgtacggtcaattccaatctgttccacaagaggagtccaatagctgtcatagtaattgcgataaagaaatcttttgccatcctctgtatgaagaagatattcgcaatcaggacaagaattataccagtctttatagtaaggcaggagtttatcagcaatcggaacttttcggattccattttctgttttgctgtcaattacatcaaaatactgttcttccaaatgtacattttctttcttcaaatcaagaaattcggagatacgtgtgccattatagagcagcatgaggatgatctgatagtatttgtcctctttcattgtccagacctttgcaacttcttctttcgtgaattttgtacgtgtatgcttgtttggattgcggtctttgtactgggcaatttcaacaaaagtagaataatctttgttgcagatgtcattcttcaatgcaaattcatacaactggttaaacaggattttgattttcttcaatgtgggaaaattctttccgcaggtgtcaataacctgttgtaagtctgccagttttaaatccttgaaaactcggttgtaaagaatgccacatgttttgtaagatgccttgtatcctttgatattgctttcggataccgtaggaaattttttcttagaccattcctcatacacttcatcaaaagtcattttggctgcctttgtatcataaggattccgattgtaatcagccagcatttgtaatccctctgtttttgtggcggcatatccaatgatgatatattcatttactttcttttctttgattggatcaatacgatagcttgtggttttacgaaccatccaaggttttcttctttttccagatagttttactacacttccgtagccgttcggtaatttcatattctaaaaatcctccttaaaaattaggactctttcttaccgtaccgctcgttcataattttttgaaatctctggattcgttcttcgtttgagatttcttctgtttctttttcggtcagttttgcatttgcgtaataagcaagtgttttatcctgccacttctgataagattcaagacttgtctgatagtccttgacttcatttcttttatcctcaaattcttccaagaatagacagagatcctgatttaactccgtagaaatatctttgccgttaaaagtaatagcacattcccatccgtcataatgtggcgggcgtttgacttcgatattgaagccaagttcctttatcttatctaactgaaataagaaattcataatatcggaaagattttctaaaggttttctctcggcatcataccctataagatatgtggattcgcagtctaaaacttttgcgatttcattgagcatagcaatggaaacttcgatttctccgctttcatatttttggattgtgcgaagcgatttccccaacaaatttgcaagctctgtttggttgatacctttttcttttcgagcagtacggattctaagtccgatttgattgttatgtaacttctcattactcatcattattcacctcacgcttatcatatcatagaaaaatacgaattacaagtgcatatttatataaaattgtattgacatgtgcagaataagtgcatataataaaaatacgcattaaaaatacatattaaaaaagaaaggagaaataaaatgaagataaacgtatttaaaatgcagattttgatgggagaaagaggattaacaattaagaaattggctgagttaagtggagtgtcaaggcagacgatttcctgcattatatcaggaaagagctgtacaccgcaggtggcatataaaattgctacagctttagatcaagaacttagtcagattgtaaaggaggatgtgaaaatggataaaagattatatgtagaattgccgccatttacgggaagaaatgtgccgattacggaaattgcaaaagcaatcggaaaagatgctcattacgttcgtatcggaatacagcagggaattttgaaatttggagtggcaatgaagatgggtgattccaatgaattcagttattactgttctgatcgtaaagtatgggaggaaactggatatttcaatggagaggcaaaaaagcagggaaaagaaaaagcccttgcgtaacacaaggacaacttctcagagcttttgataactctatctcgcaaattcagtatatcaaaggctctgagagaatacaacgaaaattttaaaggagtcgaattgaatatttttcaagtagtaaaagaaaacgtaactgcaaggcaggcagccgagcagtatgggttgaaagtcaataaaaacgggatggtctgttgcccctttcatgacgataggcatcccagtatgaaagtagatcaaggattttgctgttttgcctgtggcgcgaaaggggatgtgatcacgtttgtagcagatttctttcatcttacaccattggaagcagcaaagaaactggcagaagattttcagatacctatttttacagataacgaaaagaaaaggaataccagtaagaagaaagaaaaaccgaaaagaacattgtaccagaccgaaaagaaatttgaagaatgggaacaggaaagtatccacatcttatcggattatcttcatttattggaagaatggaaaataagatatgcaccaaaaacaccagaggaagaatggaaagcagaatttatagaagcctgtcagcagatagaaaagataaattactatctggatttactggtgtttggagagttacaggacagaattgaatttttactagatagtgggaaggttgtgaaaagaattgaagaacgaatggaagaatatagatgaaacaacaagaaacagactggaagaagcattgaatcagagagaaatgaactttaaagagtactctcaggaatggtttgaggatgggcagattgatgaggtggcattttgtgaaaatttcttacaaagaatgccattgaaatgtatcaacggtatctttttcagctatgatggaatgctaccagatagcgaggtagagaaagaaatttacagaatggtaaaaccggttcttacgaaagggatttccaagaaagtaaaacagcttttggaggttcttaaactggaagcttattccgaagaacttccggtgcagatggattgcatccatgtgaataacgggacttattttctgaatggaaatttcacagagaagaaagagttttgcctaaaccgattacctgtaaattatgaaatgaaagaagcaaagccggaacggtggatgaaattcctttcagaactgttggaggaagaagatattcctactttacaggaatatatgggatattgcttaatcccatccaacaaggctcagaagttattgattatcttaggaaaaggcggggagggaaaatcacgtattggtctggttatgagaaaaattctcggaacgaatatgaatgtaagcaatattcaaaaggtagagcataaccgttttgcaagggcagatttggaataccggcttttgatggtagatgatgatatgaaactggaagccttgaaagacaccaactacattaaaaccatagtcactttggaggataagatggatttggaaaggaagtcaaagcagagcgtacaggggaatttatatgtcagatttctctgctttggaaacggaagtctgagtgctctacatgatcgttcctatggattttaccgcagacagattatccttacggtcaaagatgtgccgccagacagagtagatgatccttatttgattgagaaactacaaagagaaacggatgatatttttctctggtgtctggagggattgaaacgattattgaaaaacgattaccgatttaccatcagcgaacgtgcaaagaaaaatctacacgaagctatggaatcagggaataacatcattgcttttatgcagtcatccgggtatatccggctggaagaaaatacaacggcgacttctaagaatctttatcaagcatactgccgctggtgtgaggacaatacggaaaagcctatgagtgcaaaaagtttttcgggatatttgaaagaaaatgaaaagaaatatcaaattcattattctacgaatattccttcggataatggaaaaaatgccagaggatttcagggaatccatacgcagatacgcatagacaactatcgttgatgcagatgagatacagataaaaaagaattttccaaagaagcgtatatgcgtatatcttcaggaaaatcaagggattacaggtttctgaaaagtatggaagatacgtttatacgcttatacgtgtgatttttgaaattattttattttttagcagaagggagtgttagagatgttaaagtagcccggaaagagaaaacagaaatgtgaatgatttattttatgagatggagggcagacagatacagaaaatgaacaaggtactggcaggcgtagaactgacaaaagcagaggaaagaactctgatatggcttgccggatgggaagaaagtaccgtagatcatctgttgtcagtcatagaaaaagcagcccggatacgggcagataaaaagggcggatacgcccataaatctaatcgtgagtccgagaagtaatcggactttgttaaacaaaaacaagccctcggcgattgagagcgaaatatacccatcgcacaaacctacggtttatactctgtgtatttcgctctgcgaggcttatgccggatacggcaatcagttcgtaaacaggtgcctatgcacctactcacaataaaatcgacgagagctgggaaaggaggatgcttataggcagacattcatttattagacaaagtaagctgtccaatgtggcaggaaggattgattatatctccaatccgaaacgacaggaatatctctatgcgacttaccagacagaaggagcaacaccagagttttggaaaaatcttgcaagagaaaattagttggattttaaggcgagtggttcatcagggaaatgtattgaagggcgtgagtttatcatagcacttcctgaaagttttgttcagtacagggcagatgatgtggtaaggctttttacggagagttttcataaaaggtatgacgtggagtgcaccgctgctcttcaccacaacaagacaaagacgaattatcatatccatctggtattcagcgaacgtaaaatattggaacagcccgaagtaaaggttgctacccgaaatatgttttatgatgagcagggaaagcatagacgcacaaagaaagagattttagatgagcagggcaatcttcgggtggggtgcagtattatccccaaaggagaagtttatgaaagccatatcttcacgaaaaaggatgaatggtttaagaacaaagcatttactaaagaagtcaaagaactgtttaccgatacgatcaaccgatacgtaaaagaggaatcagaaaaattatccgtattccaacagggcggcgtatatctggcaaccaagaaaatcggaaagaacaatccgaaagcagaggagataaaggcggacaatgcggcaaggcaggaatggaatcggacagttgatgtggcattagttgagggcgttcccgaagaagatattttgaaaatcaagcaggaaaaaatcacagacaaaacgctacaatctatcaggacacacggttggctgccggatatgttccgtcagattatccgaggggcaaaagactttttacaggaagtaattttcaaatttgaactaccgcctaaacctgtatcaaagattgatttgcaggaatggaaagagatgcagaaggtcatggaaaaacttcaaaagcagtctcaagaggtaaaacgtacacagcgggatatttcttctttgaaaaagcaactgtcagagttacgaggactatttaaaggcaaagagcgaaaatctctggaagggcgaattgaactgttagaggatttggaaaagcgtctgtacaagggtctggagcagatagtgaaacgtgaagggtatccaaatgtgcaagcctttcagaaggtctataacaaggcagaaacactaatcatagaatacaatgaagaactgtgggcatggaaaaatcagatggagcagaagaaagaaaatccattagaacagccgaaaaaaacaagcgtactggaaaagctgcaccactatcagcaggaaggcagacagcagccgaaacggccagttaagaagaaatctatggatagagaacgataagaaaggtgaaaatgattatgaagaaaacaatatttgaagaaatgggcggcacttatgtaagacaaggggattattttatcccctgtcttaccttgccagaggaagaaaatttgatttttctttaaattactattaaataccattaaatcatagaacatatgattgctttttgcatgccgataggttaaactaaggatagttatataatgcaagatatataggtgtggaggacaagatgactgatttagtagataaatggcatagtttagaggaaacagcagaatacttgggtgtaacaaaagatacaattagaaattggattaaaaaaacagatatacctgcacacaaaattggaagattatggaaatttaagttgacagaggttgatgagtgggtaaaaagtggtaaaagtgcattgtaattttagtggtaagtggggatgtaaatatgagtaaagaaagattatcaagattaatagcccagtatcaaaaaaatatggaattttatagaaatgcaagagaatttaatgaacaagattgtagagatgaatttataagtccgttgttagagagttttggatgggacgtacataatgaaaaaggaacatctccgcaatataaagaagtagttgtggaaagattctcaaacagtggagatagaccagactatacattaactttaaatggggtatcaaaaatctttgtagaagccaagaaacctgcagtaaatataaaagaagaacaagaaccagcaattcaagcaagacgttacggctggaatgccaaacataaattgtccatattaacaaattttgagtatatgatgatttatgatgttacaaataaaccgcaagatggagatacagcgacggtatcgttgtatcgaaaatatcattatttagaatatttaaagaagtatgaagaaatatatgggctaatttcaagagaaagtgtttacactggaaaatatgatagatatgttgaagataaattcccaaacgaagaacgatattcaacagaagtagatgaagtattcttgaagcaaattaatgaatggagacttgaaattggtgattatctgtactgtacagataatatttacaaagatatggatgttttgaatgatgcagtgcaggaatttataaatcaaattatttttttgcgaatttgcgaagacagaaatttgcctttgtatcaaagcttaaaagaaactgcccggaataaagtggagttgcagaaggcattaacaaaagtttttaaagaagttgataagaaatataattctaagctgtttgctggtgataatattatttttgatttgaataatgatattatttttaatatgattctttcactatattatcctaagactccatatatgtttaacattattgagccaggaattttaggaaaaatatatgagagttttcttacagaaagtcttgttgaaaaagatgaacatatagtattggctgctaagaaagagtataaatatcggtcagtggtatcgacacctgtcgaaattgtaaaatatatggtaaaaaatacattagctccaatttgtgagagaaagacaccagaagaaataaaagagcttcaaattgcggacattgcctgtggatcaggaatatttttggaagaggcttatcaatttttggttgattattgtacagaatggtatatgcaacataagccagagtatttattagagttgagtaatggaaaaaagaagctgccattaactgacaaaaaggatattttaacaaaatgcatttatggcgtagacattgatattcatgctgttgaagttagtaaattttctttattaataaagttaatagaagatgaaacgccagcatctgtgaaagaatgcgttccgattttgccagatttaagttctaatataaaaaatggaaattcattgatttccagagaagatatttcagggaaagacatatcaatagaaacattgtgtaatataaaaccatttgaatggagcatgatcaataaaggttcaaaatttgatgcgattattggtaatccgccatatgtaaaaacagaagatatacatacattagagacagaagtagaatttgcagtttataaaaggaaatataaaagtgcatataaacaatttgataaatattttctgtttctcgaagaagcatttaacctcttaaaagaaaatggacaaatgtgttatattgtacctaataaattttataaaatagtggcaggacaagaattgcgtcgaataatatctaagtatttatctaaattagatgattttggagatatgcaacttttccctgacaagactatttatagttgtattattacattatgcaaagaaagtagtaggcagatggaatatacaaatgtcacttcactaattgatctctggactggtgaagaacaggaaaatatcaggataaagaacgaactgttagacgaaaatccgtggagattaactacagatattaaatttatgaaaatgattgaaaaggtagaagaaaatggtaaaccattaggagaagtagtaaatatttttaatggaatacaaacaagtgcagaaagacctaaacctgtatattggtttggaaaagatgaaattgttttggaaacagaagaagaaataattgtagataagtttgaaaaaagataccatatagaaaaacgtattttgaagcctttcttcaaacctactaaggctgatgaaaaaggaatgggtacatattcgttgttaaaaacggataagcatattatttttccatataatgcagatggtagcttgattagtattgacattatgaaagaagaatatcctggaacatatcaatatttacaggattgttatgacttgttggttcctaaatgtttaaatggtggaaaaggtcgagacataaaaaatgcaacagccgatacatggtatcaatacggaagaacacaggcgttgactgcatttataaatactcctaagttaattgttagaattttaagtaaagaaccaatgtatgcatatgatgaaaatgatatgctcattgcttctggtggtacagcgggatattgtgcaatagcaaagttgcctgattcaaaatatgatttaaggtatatacaagcatggttgaatcatccatatacagaaaaactatttcaaattatgggaagtgattttgagggaggatttacagcgagaggaacgtatctattaaagaaaataccttttgtcgaattagattttaatgatgaaaagcaaaaagctctatatgaatcagtgctcatttctacagagaaaataaatgagttgaatattgcgttagaacagaaaaaagataaagcgtctattaatgtaatagaagcagaaaaggaaaatttaagcaaacaaattgaagataatattacaaaaatttataatttgcaattttaggtgagagaatgatattaaaagaagatagtacagaacagaaattaagaggtgcttattatacgccactaaaattggcagaaaaaatggtggattttttcaagaaggatgtatctattaaatcaatattagaacccagttgcggagatggagtatttgtagatgcattaattgaaactcagttcttgactcaaaatagaaaagtgactgcaatagaaatcgaaaaaaatgaagcaaaaaaagtggctgagaagttaaaaaataatcccaatgtatctgttgtgaatcgagatttttttgagttttatcaaaaatgtaaggatataaataaatatgacttgatacttggaaatcctccgtatatccgttaccaatatcttgaagaaaagcaaagaatggaaatggctgaaatattaacaagccatggaatgaaagctaataagttgataaacacatgggttggatttatggttgcttgcgtgcatatgttgagtgataacggaaaaattgcgttcgtaattccagcagaaattttacaggttgcgtatgcagaagatttaagattatttttgtccaacaagttatcaaaaataacattattgacatttgaagaattggtttttccaggtattgaacaagaagtggtagtttttattggagaaaaaggagattcagaaaaaggtataagaattatagagttaaataaccttgatgatctagaagaccttaatatttatgagaatggttttcagagacttagccatgtgcttgaaaaatggacaaaatactttacgacagagcaggaaaatcgattgatttcagcgttgaaaaatgataatagatttcaaatgttgtctgaaactggtcttattaatgtggggattacaacaggaaataataagtacttttcagtagataaaaaaactgttgaaacatatgatttatctaatattgttcgaccattgataggaagaagttctcatgcacatagtgttttcttcaaatatgatgattggaaaagaaatgttgctcaaggaaaagctgcttatttgattgactttccagatacttctatagaaaaatatagtcaaggacaaaaagaatatattgaacttggtgagaagaatggtgataacacagggtataaatgcagaatcagagaaaagtggtatcaaataccgtctgtatgggtaccggatgcattttttcttcgtagaaataatctgtatcctaaatttgtgttgaactgttgtgatgctgtttctacagatactatgcatagaataaaatttaataagggtattgaaccagaaagaatagttttatcgtattataatagtatttcttttgcttttacggaaatctgtggacgcagttatggtggcggggtattagaaatattgccgggagaagtaggaaatgtattagttcctattttggattgtgttccaattgaaaagattagggagatattatatcaggtagatgaaattgtgcgtaatggagagaatatcgagaaggctttgaatcttgtagataacagtattttggtcgattatttacatattaatgaggagacttgttctatggcgagaggaatatggaagaagatgcagcataggagattaaaaagaggataggggatatggcaagaagcagagaggcagtagatacaataaaaggatattattatcagtttgattactttatttttcaattaataagtttggtaaatgaaactgatactgtgacgatagaaggaattgaagatgttgatatctttgaagagaaggaaatagttgccgtacagtgtaagtattacgcaaaaacagaatataatcattcgattattgcaaaaccaattagacttatgcttaaagactatgtcaatagaactccagaaaaaagaaaaatacgatataagttatatggtaaatatcaatcagggcaagacaaatatccgggaacgttaaccgtagaatttgcgaaaaagaatttgtttacatataccgagaataaagtagcacatgcgttgcatgaagaattaaacttagctgataaagatatagaggaatttctgaataaggtggatgttgatattaatgcagaagattatcaggaacagcaaaacaaagtaatatgcggtttagaaaggatttttcaatgtgatagatttgaggcagaatattactattataacaatgctcttagattagttaaagaaaaatccgtgcaacagaaaatgtgtgataggattgtaagtaaaagagaattcttagataaaatcgataataagaaaatgttgtttgataaatggtatttacagtttaaggggatacgagattattgtgctgatatacggaaacggtatttttcacaaaaaaatgtgtctccatatgagagattttttctgatcgaatgtgatacagtggttgatgatacccaaattgtttcgttgattgcaaagatatcaaaaaattggagtaagttatccagaagggaagtaaaaccattttgtccatatgtttatttgaagggaattgctcaagaacggttagttggtttgaagaaaaaattacaacgggaagacattcgtttatgggatggatatgattttttaggcgcagaatttatggttgattctattatacggagggcaaattacgaaaataacataaaagtgaaaataattaatcatattgaaaatttgaaagatattttagaaaaagcaacaggaactaaggtgatttatcaattctatttaaaggaaccattttatgaaagtgatcgaaatctttgttatggaatacagatttctaaaacagaagatattaatatgatgatttaaaggggaagaacgatggaagaaaatgaaaaacttaatgcagaagttattgcagtcttgccgaataaggtaaaaatatcagttgatgatttagaaaattttcaattagcagaagaaaaacttaaggtaggatcatatcttcggattgctgataatgataatgcagtattgatagcaataattgaaaatttcaatattgaggttggagttaatcaaagcggagaatccaatagaaaatatatattagaggctaatccgttaggtataattagaaatggtcggtttgaaagaggtggagatacaatagcaattccacccaaaaaggttgaacctgcaaaaaaagaagaaattcaaaaaatttttgaagaatcgttggagaatgaaaaaaagtttagtttttcaacactatcagcagatagaactattgaagtacctgtggatggagataaattttttaataaacatattgctgttgtcggatcaacaggatcgggaaaatctcattctgtagcaaaaatacttcaaaaggcaattgattcaaaagaagggatatatcaaggcctaaataattcacatatagttgtttttgatattcattcagaataccatactgcatttccaaatgctaattttattgatatatctaatttggtattgccgtattggctattaaatagtgatgaattacaagagctttttattgatacagaagctaatgatcatagacaaagaaatgtgttgaaagaagcaattgttaataaccgaaaaaagcattttgatggtgatactgcattaaaagaaaagattcattttgattcgccacttttttttgatgtcaacgaaatacttacgtatataaaaaatagaaataacgaaaagaaaaatacaaagaatgctattcaatacaaaacagcaaacggagaaacacataattttgatactaaagaatctgattgtttgtttgaagaagaagtcgaatatatagggacttcagcatctggaacaaataacggaagcttgataaattttatagataggttggagaataaaataaatgataaacgattaaggtttttatttggagaagattcaaaaaaaatttctttcgaagaaacattgcgtgaactgttaggatatcaagaaaatgaaaagtccaatattacaattttagatttgagtggtgttccatttgatgtattaagtataacggtttcattaatttcaagaatcttatttgaatttggatattattataagaggatgtgtgcagaaaatagcacgggagaaaatgatattactaatgatgtaccggtattattggtatatgaagaagcacataagtatgttcctaataatgatatggcaaaatatcgagcatcaagagaatctatagaacgtattgcaaaagaaggaagaaaatatgggatttcattaatgttggctagtcagcgcccgtctgagatatcagaaacaatcttttctcaatgtaataattttttgtcactacgtttaactaatccggcagatcaaaattatgtaaaaagattgttgccagatacattagggagtattgtggataaaatgccagttttaaaagctggtgaatgtttactcattggagatgcagtagtattgccttcaattgttcaaatagaagaatgtaatccaaaaccgtcatcaagtgatataccttacttgcaattatggaaagaggaatggcattcgttaaatcttgaagcaataaaaaaagcgtgggagagataaaggcgttttagaatatctgtgaatctaaagagagggaatgatattgtgagagatgataaaagagaaagatacacatttgttattttgtgtcatccctttctttagtaactttgaggtgtgatgagaagtaatgagaagtcctgcgtttgtaacgtgtttgcaacactacattccaagaattcagtaaaatcaagcgttcccagttctccaaacgataataaaaaattatataagagaattaatcaaccccatgaaaacagcaagttttcgtggggtttctgttttgttgaaaaatataaagttttactaaaatatacaattttgaaattgtaataattaaaatgatgtgataaaatttggttatggaacaaccgtgttacagggtggtttgaccttcattctacatagaatggaggtggtgccaatgaagaacaaattcagttttaatgacttgatgcagttcggattatttttgattgcactactgaccttcatatatttgattagtcattagttacgcatagaaaaaccacccttgagaactttggcaagtaatagggtggatttcctgcttttattattaggtcaaaccgctttggacggttgttcctttttctacttaaaatataccactaatttaaaagtttgtaaagaattcattgctgatgaagatgaaatacaggatcacgattgatcatattaatcatgttagaaatatcttcacaagccatctgaaacttcgacttttcaatcagtatgttttttcctgtcataatataggagggcattagccgtatatttttatagtatatttcgctgtggcgcagtttgtatgttgaaacagcaggaatcacatttcttttcgttgttcttttagcgatcatattcattgctttttttgccacatcccccatcagcatgactacctgaacgttaggaaataaggcgagctccttttcaagaaaaggcaggctttcttcgatcatgcttctttcaaggaaagtgtgagattttggtttctttactgcatttgtaatataaatacctaagttcagaagttcctctgacgtgtttgcttctattcctgcgttttggaaaagacggacagcagcagaaagatattctccatcctgttttccatagaaatcgttctcaggatctttggggacgacttcattaataagtacagcattgatattctctgggataacatcgacgtcattgaaataaaaattactgcccgaagcatctatgctttgtaaactcttttttatattcatgattctgctcctttgtgatggttgagagctttttcgcagcgctctatgatttcttcttttaagctgatcggacgtacaatttcgacattttctccgaaagataacagcatttcatacagccattcgttccggggaagtgatgcttttacaataaactgttgatcgttttgtatgatcgcctcttcactgaaaatatctaaaaccctatgccccatgtctaatggaaaccgaagttctatttcatttaatacttccatgtcctcaggcagcggcaaaatgtttaagttatcatgaggaatttcatcaaacataacttctgtgagcttcagactcctcatccttgagacacggaataatctgtaatcatttcttttgcagcagaatccaaacaaataccacgatctgtctttatataataattttatcggacggcaccgcctttcactgacctctcccctggaattataataacaaaatacaatttcctgcctttttaaaacagaaattttcagcagagaaaagatttcatgttctttttgaacgcaggctccccagcgggaaaaatcaatttcaatccagtctgtatttgtcttcttaaaaagagcacctagtttttctaatgtaccttcatgatcggaatattgggcagcggataagctctgaagaccgataaagatatcctgaatatcagactcagacagcaaagctttgctgatgataaaatcatcatacagtttaataccgccgtcccttcccgcggcggcatacactggaatacctgcactgctcattacatcaatatcgcggtaaatggttctcacagatacttcaaattttgaggccagttcaggtgcagttgcctgtcctttttccaacagatagtaaaggattttgaataagcggctttcatgcaatcgtttcacctccttgtctctctattatatcagacaaaccctgacaacgtgtgtcaggatacagaataaacaaaatggggcgataattgtaagtgtaaaattatgataaattttccttttcaaatccgtgaaaatatattgactatttttgataagatgttataatgagggcatagataggattgtaactcttcgaggcattacctttagtgtattaggtgtgctgagaagagttttttattttataggaaagttctgcggtctttcctaataaaataaaaacgctctgcgggttgtacacagatgcgcagggaaatcatttgccttcggcaaatcgtatatggcacgcaaagttatcaagccctcaaagattgagggttgggagttgaggtgtgggcttgcccactttgttctttgtggaaaggggaaatatgtttaacttttttaataagaataaaaattcagatggtgttatgatgtcaccagtcaatggattgtgtatagatttatcagaagttccggataaagtgttttcagagagaatgataggggacggtgtggcattcatttatgaggatgatatgatatgttctccatgtaacgggacagtagttatggttgcggatacctctcatgcaattggcataaaaagcggagagattgaaataattatacacattggattagatactgtggagcttaatggggaaggcattaaagtattcgttaagacggatcaaaaggtaaaagtaggaacaccattagttagaatcgacaggaattttatgaaagagaagtcagtgaatttaactacgccgatgattataacaaatactggggattttaaattagagtttaaaaatacagggaaagaagtagagcgcagtaagtcagaagtgataaagtataccaagagtgaatagataagcattaaaattatttattttaagaagaagggggggatttctttgtgaggattactaaaaaaattaataacaacgttgcattaggggtagatcctaagggaaaagaagtagtaattttcgggaaaggaattggattccacgaaattccttatgaattaaacgacttgtctttgattagtaaaactttttatgatattgatccaggctatttggaattattatctgaaattcctgaagatatttttaatgtttcatctaaaattgttgattatgcaagaagtaaagtcggttgtgaactaaacccaagtctggcatttatgttagccgaccatattaattttggtgttataagattaaagaaatccatagatattaccaatccattaaccaatgatataaaatatttatataaaacagaaatggagattggatataaagctctggatatgatagaggaggatttacagattcgctttccgaaaggggaggcagcaagcattgcactgcatattatcaatgcagaaggaatgcaaaacgatatgaataatacaataaaagttacgaagattcttaaagagataactaaaatcgtggaagaaagctttgattttaaaattgatcaggatagtattgactattccagatttgtgattcacttaaagtattttgtacagcgtgtgaaagaaccaaaagagaaagtttcagattctacaaaattgcttcttaaatctataaaggctcaatttccggatacgtatggatgttttaagaaaatagaaagctatttaaaaaaaacattaaagttgaaatacagcgaagaggatcaattatatttattggttcatatcaataggattttagataactaaagaacgcatgtcacgtattaccctaaaatttatatatttttccgcattggattgtaactctgccttgaggcattaccaatgataaatattagtatatttatcatttgctgccttgaggcttttttatttaattgatgtcaattataaggggggataaagatgtaaacaataaaaataatttatgtatacaagtttcattcaaaaatggaggtgaacatgatgtcagcaagtaaattaagtaagaacattatttctaatgtaggtggtgtggaaaatatcaattcattaacgcactgtgtaacaagattaaggtttgttcttaaagagaaagaaaaagtagataaagataccattgataacctggacggagtaacaagttcattatattccgggggtcagtatcaagttattattggacaagatgtggcagatgtatttgaagatattattagtaattatgaattgaatggtactaaaaaaggcgctgctgatacaaatcagggggaagataaaaagagtattttggggcgtttagatcaattgttcagcatattagcatcaatctttacgccattaattcctgcgatgcagggtatgggatttttgaaaataattttggtcttagcaaaatttatgggtgcgtcaccggaaagcactacttatcagttggtcaatacattatcagattcttttttctatttccttccgtttcttgtggcgtggtccgcagcggaaagatttaaggctaataaggcactggctttgatgttaaccggattgctgctgcatccaggttttatggaattattcaaggcaaatgaacaggtttcatttttggggattaatgtcccgaatataaattataccggaagtatattgccgccaattctgacaatacttttgttatcatatgttcaaaaattattaaataaattactgccaaaactttttaagacagtattttcatctgtgatcgctttgattattacaatgccgattgcaatcttaattattggaccgattgggaattggggcggtgctgtattagtaaatttattcaatagtttatatcagtttagtccattgctgtctggtgcagtaatcggaggactgtggcaagtaatcataattgttggtatgcactggctggtactgacattgattcagttcccgaatatagatagtttgggagtggacagagttacagttgcgtttgctcctagtataatgtgtcaaattgcagcaggacttgccgttgcattaaaagttaaaaataaagcggttcggcagaatgcgttatctttaacagtaacaagtttactctccggcggagtaattgaaccggtaatgtatggggtaaatataaaatatagaaagcctttctactttgtattagtaggaggcgcagtaggcggagctattacaggagcatgtggagcagggattaccgctccggttatgtttggtatatatacgttgccggctttctttggcaaaggatttacggggttgatgataggaacattagttggttgttccatgacatttttattaacctatttcttcggagttgacaaggcaatcgaagaaaaacaaaagaaagaattagaagcttacacagcagaaattgtatgagaaggagatagattttatggaaaaacaatatttatataacaagattaaagggactttagtagctgcgggaatgggagatgcaatgggggcgccttcagaggcttggagcagagatgaaattattaaaaactatgggggaccaattactgattttatagatccaagtttaaatctttatgtgaaagataacctgatgggtgaagttacagatgatacatctcagatgtatgaaatggcattggcagtcattaaatctaaaggaaattttacggtaaatgatgcagcaaatgctttgatagaatggtcggaaaaatatccgaagtattatccaagaaatgcaggaccaacaacaaggtatttgatagaagacttaaaatcaggtaaagatcctgttgaattggggaaaacgggcggaacatatgaccgtggaacttccaatggtgcagcgatgagaattgctccggcgggattgctgtttcctggaaatttggaaaaaaccatagaagttgcaattaccatgactaagccgtcccatggaacacagcatggatattcgggcgcatgtgcaattgcatgtggtatctcaaatgctttaatggaagattctgatttatattctattgtgaaagcttgtctttacggagcgaaacgtggagaagaaattggaagggaagaagccagaattgctccgggatttgcagtttatgaaaaaattgttaaaagtatagaaattgctttaacctcagatcacatggacgaagcgatggaaagattggaaagaagtgttggaaatgacggatctattcaaagttctgctgcatgtgccattggtcttttcttagcaagttccggagatgtattgaaaacaatcatcggcggcgcaaatattggcggagataccgatacgattgcatgtattgcgggaatgttagccggcgcatatacaggatttgaagggatagacagtgataaatttgaagtgtttaaaaaggctaatacaggatttgattttgataaagtatctgaagaactgacagatttagctcataataattatttgaatgccaagtaattctttaaacttcttaggatgttgttttgattcttatagcggtctcctttagaactgtctgatatgatagagacttaaaggaggctgtttttttatttcctgatcatgctcagacaaaccctgacaacgcgtgtcaggataaaaatggatgttgacaatatgaaaagcagagactataataaacaaaaacaagaaatgaaatgaggtgtcttggtgttacgggtttctggaatgagcattgcagaaaaataaaatattgatcagggacgacaggtatggatatgccggtctgtcttttgtcagcctgcatataaagcagactgatctgatattttgccttacaaacccgtttcatacgctttatatagatggaaagagatgttggaacatagctgtgtaatgctgtgtttttttattcttatcatttagaattcttttgtcagaagatcacagggaatgtgccggtttcggggcaatgtatctgtgatctttattttatttcaggaaattaaactatgataaataggcatcattctgccttgactgagaaaggaatctatcatgaaaaataaatcgttgacaacattaggatatcatcagatattagagcagctcaaagactatgcattttctgcgggcgcaaaggaacggatcggccggatgctgcctttattgtctgaactgaagctgaggaaacatataaatgacacatcccaggcaagaggaatggtggagacatatggaacaccacctctcccggccatggaccatatggaagaatatataaaaaaagcagctgcgggggcactgctgctgccggaagaactggaagaattatgtatgtttttaaattctgtcgcacggctgaagatctaccttaagaaaggggaggctgaacaaatcagcctggctttttataaccagaatttagaatccctggatgacctgaaagaggagatcaggcagtgtatcagaaatggaagggtagatgactatgcgtcaccatacctgaaagacatccgaaagcagatgcttctgctcagtgagaaaattggagagaaagctgaaaaagcactgagggcaaataaaacgtatttgagcgatgcatttgtagtgaaaagaaacggaaggtattgtattcctgtccgtaaaaaatgcagaaatatggttttgggaagcgcagttgaccagtcttccaccggtgccactatctttgtggagcctgcttcagttgcagggctcagagaggaactggaactttatcagattgaggaggattcggaagaaagaagaatcctttacagcctgacgagcctggcagcacaaaatgaggaagctttgaaagaagatattcgtgtgatcgaaaagcttgactttatatttgccaagggacgcctgagccttgaaatgaatgcagtggaacctgagattaatacagagcattacatcaggcttaagaaagccaggcatccaatgctgtcaggggaaacctgtgtgccgttagactttgaaataggcagagaaaatcgcggagtcatcattacaggaccgaatacaggcggaaaaacggtagcaattaagacggtcgccttaatgagcgcgatggcatgctccgggcttcatgttccctgtgaatgtgcagaactctgtatgcagaatgagatcctctgtgatattggagacggacagaatatttctgataacctgtctaccttttcagcacacatcaagaatgttctggaaatattaaaaagaagtcagaaagacagtcttgtcatattagatgaactgggttccgggaccgacccggcggaaggaatgggaatcgcagtggcgatcctcgaagagttgagaaacagcggagcattatttctggtgaccacccattatcccgaggtaaaagaatacgcagaccggtatccggaagtggtgaatgcaaggatggagtttgacagggaaactttgaagcctttgtaccggctgaaggtaggcgaggcgggagaaagctgtgccctctatattgcaaagcggcttggtttcccgggggcaatgctcagtgccgcagccagagaggcgtacggagagaaaagtgaggctgtcatagacagtttgcagctgacggatacacaggagaagctgcggcgtgaaaaagccccgtccattcaaaagacagagaagaaaaaagaaactaaaataagaagatttgttaccggggacagtgtgacagttctgccggaaggggagattgggatcatagtgaagcctgccgatgaaaatggtcaggtactggtacagattaagagagaaaagaagctcttcagccataaacgtctgaaactgaaagtagcagcatcagaactttatccggaagactatgatttttccgttatttttgatacagtagaaaacagaaaagcaagacataaaatgggaaaaggtttccgggaggacctggtcataaagacagaggaatagagaaaaaacaggaggaattgagaatgacagagaaggaaaaagcggctttgggaatgctttataatgcgaattatgatacggatttaaaggaagagcggcttgactgccaggagctgtgtgcagaatataaccggctgatgccgaaggaattggaaaaaaggacagaactcatgaagaggattctgggaaaaacagagggagaatttatggtggagcagccgtttttttgtgactacggttataacattgaagttggtgagaggtgttttctgaactatcactgtactattttggacggagccaaagttacatttggacacgatgtcttcgttgcgcctaattgttctttttatacagcgggacatccgtttgatatagaacagagaaacgaagggcttgaatatgcctatccgatccatataggaaataatgtctggatcggaggtaatgtgaccgtgcttcccggcgtgaccatcggtgacggcacagttgttgcggccggaagtgttgtgacgaaggacctgcccgccggggtgctggcggcaggaaatccatgcagaatcattcggaatctgtctgaataacagaaagcagaagcggcagaaaattaaggctgcattgcacatttttaagtacaatgctatactctaattaaaacgagggaaagaagtgtgatgcaaatgacaggccttatattacagcttgaatacagtgcaaggatccttctggcagcagtctgcggagcctgtattggctatgagcggacgaacagactcaaaaccgcgggcatcaggactcatgtgatcgtatcattggccgccgcgctgatgatgattatctccaagtatggattcagtgatattctcgccgtccacaacgttggactggacccgtcaaggattgcagcaggtgtcgtaaccgccatcggttttctgggtgcaggtattatctttgtacataaccagagtgtcagcggactgacgaccgcggcgggcatctgggccactgtgggagtcggcatgtccgtaggcggcgggcagtatctgatcgggattttcagtacgattcttctgatcattgtgcagtgggtcctgcaccgtgattttaagtggatcaaaacgcccacggtggaagtgattaccctgaaactgcccaatggccctgacgctgtaaagatgattcaggaaacgatcagggaggagtccatagaaattttaaacatctcagtccagaagataggaaatgagagcatcaaggtcagactggacgtgaagctgccggacagctttgatatgtacgatgcgattcagcggctgcttgagaatgagaatattgaatccattgatatttaagattgaaagaaaattataagaatcttgaagcttttttttctgttctttatgataccctgatagaaagaaaagggggtagttttatgggtaatcataggaacagaaagcttcgggatggaatatttaacggagtctttattttttatctggcatttctgctggaaaatattctgtttaagtatgtacagccatggcagctgtttcagcatggaagatacttttcaagatctttaaatttagttccgtttcggcagattatgagttcttcaggaatcggcgacctgaatatttatgggaatatcattttatttctcccgctgggaatttatctgatgttctttatgaaaagaagaaaagcggttaaaagcctgctggcagtctttggcatcagcttgttctttgaagcctttcaatatgcagcagccattggagccacagatattgacgatattattttaaactgtgccggaggactttttggagttatgtgttataaagttctgctgtttgtctgcatgggaaaggaagagaaggcaaagacggctgttgccggaactgcagccgtggtcggaatgatcactgcagttcttataggcctgctcattgcctttaattaaggctttacaagatataaaaggtattttatactttaactaagaaaaagaaatgaggtgtggaaggatgatgatgatttcttgctaaaatttaatcggcataagaggagaaggaggtttccttctggttttatgcgctctgcaagaaagatcatccgaactgcttctatatagattgatattagtgtacgcttggcgtgcgtgatatttttgtatgcgaacctgcggggaaagtctttcctgcaggttttttgttttattaaataacttatcacggtcaggaggtacctttatgtctaggattcaaatttcagatttaacgttttcctatgataccagtttcgattatatttttgagcatgtctcatttcaaattgatacagactggaagcttggatttacggggagaaacggaaggggcaaaactacatttttaaaattattgatgggggagtacgagtataggggctctattgcggcgagtgtatcatttgattattttccgtatccggtaaaggacccggcgatgctcacggcggacgttctggagtctatagacccgcaatatgaactttggaaggttatgaaagaactgtcacagctggacgtgccggatgaagtcctgtaccgcccgtttcaaacgttatcaaacggagagcagacgaaagtgctgctggctgttttgtttggaaaagaaaataattttcttctgattgatgagcctaccaatcaccttgacgccgaggccagaaaaaaagtgggaatgtatttaaattccaagaaaggatttattcttgtatcccatgaccgggcatttctggatgagtgtacggatcacattttatcggtgaacagaacggatatcgaggtccagaaggggaatttttcttcctggtatgaaaataagatcctcagagatcagtatgagttttcagaaaatgagaagttaaaaaaggaaattggacggctttcaaaatctcagagaagatctgagagatggtcagatcaggtagaaaagacaaaaaggggcaccagagactccgggctccgcccagacaggggattcatcggccataaggcggcaaaaatgatgaagcggtcaaaggcggcagagacaagaaaggaagaggcagttagagagaaatcaaaactgttaaaaaatattgagactgcggaatccttaaaaatctctcctctggaacaccatgcgaagaggctggcagtattggaggatgtatcaatttcctatggaagcaaaattgtaaccgaaaatctgtcctttcatattgaaaagggggacaggattgccctggttgggaaaaatggctgcggaaaatccagtgtgctgaaacttttgcttggaaagccggtggatcacgtaggttctctctacaaagccaatggtttgaaaatttcttatgtaccccagaacacagatgggttgaaaggggatctcagagagtatgcatacaactgcggtattgatgagagtctgtttaaagcaattttgaggaaactggatttttccagattacaatttgaaaaaaagatagaagaattcagcgagggccagaaaaagaaggtgctgatcgcagggagcctctgtgaacaggcccatctgtatttgtgggatgaacctttgaactatattgatgtattttcaagaatgcagatcgaagatttactaaaaaacagtcggataacgcttttatttgtggagcatgaccgggcgttctccaatcaaatcaagacaaaagaaattttaatgcaataaaacagtacccagaatgaagcctccttcaaatggaaataataacttccagataaggaggcttttatgattcattggatagacaaaaaatttaaattaaaagagcatcatacagatatcaaaacagaattcctggcaggtattactgtgttcattacaatggcctatgctctggctacggtgcctaacatgctggaagccacaggggtggataagcatgtgctgatgacggttatggtgctgctcatcgccgctgcgacacttgctatggcgttttacacgaaccgtccctttgccctggcgccgggactcagcagtgcgggaattgtggccgctatgataagcgcggacaatgtaccggtaaagattgcaggcggcatcgtcttctggagcggcctgctgtttctcgccattacatttctgggtctcagggaggcaatcgtaagagctatccccgccagcttaaaatatgcagtcagcgctgggatcggtatttttattgttctgatcggagcgagaggagcgggtatcattacggcagatgaggcaaaaaacagccttgtattcggcagccttggatcgccggaggtgatcgcggcagtctttggatttgtcattctcttaatcttaagggcaaagcgtgtgccgggagatatgattttatctattctggcgtccaccatagccggaataccgctgggagtcacgaagctgcccgaacagattatttccatgccggctcctgtcggggaacagctgtttcagattgatatctttggagcgcttcaggtattgtatcttccgttccttttggccctgtttgttccggatttctttgctaccgtagggacaattcttggggtcggtgcccgtgccggatatttggatgaaaacggaaattttgacggcattgatcagtgttttcaggtagatgcggctgcaacgagtctgggagcactttttggaatgcctggcatgactacttatctggaatcctctgcgggtatagaggccggaggaaagacgggactgaccgtggtgtttacgagtatatgctttcttctggccctgttttttgcccctgtggcccttatcataccttccgcagctacggctccggtgttggtctatatcggtatcagcatgctggaggctatgcgccatatcaattatgacgacataacagagagtatgcctgccttcatgtgtgtagttttcactgtactggcaggaaatatcgcaaacggtatctgcaccgccattctgacgtatctggttatgaaaacggcggaaggaaaaacaaaagagatacatccgttcatgtatctcttaggtgcggtcagtgtgctttatttttataccctgttttgacaaagaatattttcagcgttttttgcggaactctgtataagaatatacaaacggtgtgacgaccatgaccgcaaggactgtcagaaagacaggtacctgaaacgattcgggtgcaagagcggtaagcgcgactatcaagcctcccaggacccatatttttccggcgatccggtgtgtccgaaaccagttttgttcatcggccagagtccatggagttcggataccgataaaataattatgttttgttttaggcagcagattgccgataaaaataaataaacttcctattcccaggcagaagatcaggttaacattaaaatccatcctgaaagcggccgcaatggtcatgatctggacagcgaagaaaaccaggccgatgacaaaggtgtagcggtgatattctctctgaaatttatcataattatcagagtttggatctgtgcgccgcataaactgaaaaagtatggtaattaaaaaaatgatgccaggaaatataaacaccgtaagtttcggggcaaaacggtcaaccgtcccgtgaacattccaatgggccgggatctgttccggaagggaagaaaaaactgtaagagacagcagcagggagacaactgtcagtaaaatgcttgatttagattgtttcatttatttgtcctccttaaagctttgaaaccagtgaatcacttcttcaaatacagagagattcaattcataataaatatattttccttgtttcttgtcggttatgagatttgcctgttttaaaatgttcaggtggtgggaaatcgatgcgcctgtcatatcgaaatgactgcatatttctcctgccggcatggaaccgtctttcagcaagtctaaaatttcacgtctggtggaatctgataatgctttgaatgtttcctgaaaacccacagctcctcctttctgatacatttagaagtttatctaaatgtattgtaccattctgctcatacaaaagcaagaacatttagaagaatatctaaatgaagtgtgaaagaagaaaaactatcgaagatggaaacttttgtatctaagcagcctgctccagcagacattacgtccattttcaccagttcgaatgcaagccgcagaactggtgaaaatgtcatgacattttccacatgatttccgttcggctcttagaatgcctcactccaatcatgtggaaaatggacttaatgtctgttggagaagggcctctgtcaaaaaaggtgccacttttcgaaagttatttaccgctattgtaggagcgcatttcaaaagcgcgacggaaatagtggtaaataacttatgcaatatcatccaagattttctcaacatatttatgttacacttagtattatgaaagaaataagagaaatattttatgacgaacaattaaagattgaagcctatggtttttacggactcaaacaaaaatttccaaaccatttccatgatcattacgtgatcggatgcatcgagagcggtatgcggaaagtgacctgccggggagaggaatttcttattgaaccaggggacctgctgttttttaattacagggagaaccatgcatgcgagcaggtgggggattatcctctgaactgcagatttattaatatcaagagagaaaggatgaaagaaatcgcagaagagatcacgggaaggaatgaatatcccgagtttgtaaaaccgatgattcgaaagtgttcaaaagctgagcttctcagggaagtgtaccgaatggtggcagaggggagccaggaatttgaaaaggaggagttattttatcttctcatggagcagctgctctctgagtatgcggtatttgaacagaagaaagtacaggtgcctgacacagaacggctcaatgctgtatgcagttatatgaaggagcattacagtgagaacgtttcactggaacagctctgtaagattgcaggcgtcagcagatacagcctgatccggtattttacaaagtacaagaagattacaccgtaccaatacctggaatccatcagggtaaaccgggccaaattatatttggagcagggaaccgagccggcggaggcggcggcaatgaccggattctcagatcagagccattttacaaacttttttaagcggctgtttggcctgacaccggctcagtatcagagaatctttacagacaagaaaggttattaattatggaagacaaaaaatacatacagggtcatttgtttgcactggctactatttttttatggggaacaacgtttatctccacgaagattctgctcaggcagtttcagccgattgagattttatttttccggttccttctgggcttcttggtgctgattcttatttatccaaagaggctgaagacagaaggctggagggaagagaaatattttatggccgccggtctgtgcgggatcacgctgtactatttatttgaaaatattgcactcacatacacgatggcttctaatgtgggagttattatttctatatcgccgttttttacggcacttctggcaagggtggtgacgggagaaaagtctcttggaagacggttttttcttggatttcttttggccatgtgcggtatctgcctgatttctttcggcggtactgcgctgcatctgagcccaaaaggggattttctggcagtgcttgctgccttcgtatgggccgcctattccatgctgacaaaaaaaatcggaagcttcggacacaatatcatacagtccacaaggcgctgttttgcatggggacttttgttcatggctccggtgctgctgtttacggatatttcattggggagacagagatttgctgatcctttaaatcttgggaatcttctgttccttgggataggcgcctcagccatctgcttcgttacctggaatacggcagtgaaaaggctgggtgcggtaaaaactactgtttatatctatatggttccggtggtgacgatcattacgtcggtcctgatccttggtgaaaaactgactgtcagggcagcatgcggtgcttttttgacgatcgcgggcctgtttttatcggtggaaaaaaagaaaaagagtgaaaagtgtgacttactcacagaagtattataggaaagcggtataatggactcagaaagtaaacgatgatttagaaaaggagtgaccattatgtcagttttaaaaataacagaagcaaattttgtcgaggaagtattaaatgcaaaggagccggttctgatcgacttttgggcagcatggtgcgggccgtgcaggatgatgtcgtcggttgtggatgagattgcggaggaacttcacggagtgaaggtcggaaagatcaatgtggatgaggaacaggaattagcaggaaaattccgtgtcatgtccattccaactctattgatcttcaagaatggaaaagttgaaaagagttttgtgggagcaagggataaaaaagaaatcgtggatgcccttaaaatacaggtgacagaataagatgccgagggaatgtgttataataagaaggaaagacagtaaagtaaaagaaaggggttttccttatgaaaatttatgatttgatcatcatcggcgcaggacctgcaggaatgtccgcagccatttacgccaagagagctatgcttgaagtcttggttttagaaaaagaagcaatgtcaggaggccagatcgtgcagacctatgaagtcgataactatccggggcttccaaagatgacgggtatggatctgggagatcagttcttcaaccatgcttctgacctgggagcagaagtcaagacaggagaagtctcagagatcaggcatgaccagccgataaaagagatcgttttaaaaaatggtgaggtgctgaagaccaaaacagttatgcttgctacaggggctactcacagaaagctgggtgtccctggagaggaagaactgacaggtctgggagtttcttactgtgcaacctgtgacggagcgtttttcagaaacaaaactgtggcagtcgtagggggcggtgatgtcgctctggaagatgcactgttcctgagcagaatatgtgagaaagtatatctgattcacaggcgagatgaattcagaggggcaaagattctccgggatcaagtgacgaaaaacgacaaaatacaagtaatatggaatacggtagtgacgaaaattgacgggaatgagagggttgaatctatttccatcaaagatgtgcataacgatgtggataagtcgctgaaagtcgatggaatattcatcgcagtaggcacggctccgcagagtacgctgttaaaagatgagcttgaaatggacgaaagaggctatattgcagccggtgaagacggagtgacaaacattccaggaatttttgtaggtggggaccagaggaccaaaaatctgcgccaagtggtgactgctgccgcagatggggcaaattgtgtggtgtcagtggagagttaccttcaaaagttagaattgccagacaattaacgaaacatgcaaaaaacttaaaaatcaagtggaaaagtctgttttgtcatatttgtataagagtcgtattttcaagtatcaaatcgaaaaatacagaaaaaaaacatcacattttatccacagtgcaaaatcacagttctccgcgataatacagttatacacaaagttatccacattatccacagccgattaaggtcgaattgtggaaatgaaattcgacaaaatgaaacacttgttttgtgtagattttataaaaagatttgttttcaatggaaaagctatatgatataataattagtatcaaatagtaaaggagttggaagccatgaattttattattagcggtaagaacatcgaagtaacagaaggaatcagggcagcaatagaagagaaattaggcaggcttgacaagtacctgactgatgacattgacatcatcgttactttgagcgttcaaaaagagagacaaaagattgaagtaacaattcctatgaaggggcacattatacgtgcagaacaagacagtgcggatatgtatgtatccattgatttggtcattgatattctcgaacgtcagatcagaagatataaaacccgtttgatgagtaaaaaatatgaaggtgcaggactgaaacaggaattcatcgacaaggacgaggatgtggatgaagatgagatccgcatcatcagaagcaagaagtttgcgatcaagccgatggatgtggaagaggcttgtatccagatggatcttctgggacacaatttcttcgtattccgtaacgccgatacttttgaagtaaacgtagtatataaaagaaagggcaatacatacggactgattgaaccggaattttaggaataatgatttttttaggaggcttcggcctcctttttgtttacggtaaaaaacgtgttatttgcgttggattttgggcgatggaaagggggacaggtatgatatttgctgcaagtacctttttcttgcctacattttatagaagtgttacaatatcatagattacatgtgaatttgattgtttgggagtgaaactatgagtttaataggaaaaatttttggttcgcacagtgataaagagctgaagcggatcagtgggattgtgaataaaattgaatcttttgacgaaccgatgcagaaattatctgatgaggaactgagaaataaaactgctgagtttaaagaacgtctgagtaatggagagacactggacgaccttctgccggaagcttatgcggttgtccgggaagcgagtgccagaaccattgggcttaaacactatcgggtccagctgatcggcggtatcattcttcaccagggaaggatcgcagagatgaggaccggtgaaggaaagaccctggtttccactctccctgcttacttgaatgctctggaaggaaagggcgtgcacatcgttacggtcaatgactatctggcaacccgtgatgcggagtggatgggaaaagtgcacaacttcttaggcgttacggtcggtgtcgttaccaacgagatggaaaacgacgagcggcgggtagcctataactgtgatatcacatatatcaccaacaatgaactgggatttgattacctgagggacaacatggtcatcgaaaaagaagatctggttcagcgcgatctgcactatgccattgtcgatgaggtcgattctgtcctgatcgatgaggccagaacaccattgatcatttccggccagagcgggaagtctaccgagctctaccgtgcctgcgatattcttgcaaggcagatggagaggggaagttctgacggggaactttccaagatggatatcctgatgaacgaagatattgaagaagacggagactttttggtcaatgagaaggataaacacgtacttttgaccgcccagggcgtgaaaaaggtggaggagttcttccatatagacaacctggccgatccggagaatctcgcgatccagcacaatattatcctggcgcttcgcgcccataatcttatgtttattgacaaagattatgtagtgaaggacgatgaagtgctgatcgtcgatgagttcaccggacgtatcatgccgggcagacggtattcagacggacttcatcaggcgatcgaggcgaaagaaggcgtgaaagtaaagagagagtccaagaccctcgctacgatcacattccagaacttcttcaataaatataataagaaatccggtatgaccggtacagccgagactgaggaacaggaattccgtgagatctacggcatggatgtcgtcgttataccgaccaacaaaccggttgtgcgtgttgaccacgaagatgctatttataagacgaagcaggaaaaaatgagggcggttgttgaggacatcgcagcatcccacgccaagggacagccagtgctcgtaggtacaatcaccattgatatgtccgaagaactgagccgcatgctcaaaaaacaggggatcaagcataatgtgctgaatgccaagtttcatgaaaaggaggcggagatcatctcccatgcaggagagatcggagctgtcacaatcgctactaatatggcgggccgtggtaccgatattgtcctggcagacggtgtagccgctctgggcggtttaaagatcattggtacagagcgtcatgaatccagacgtattgacaatcagctgcggggacgtgccggacggcagggagatcccggtgaatccaagttttatctgtccctggaagacgatttgatgaggctgttcggatctgagaggatgatttctgtatacaatgcccttggtataccggaaggggaggaaatccagcataaatccatcagcaggacgatcgaaaaggctcagaagaagattgagaataataactttggtatccgtaaaaatctgctggattatgaccgtgtaaataacgaacagagagagatcatgtacaaagaacgccgccgtgttctggacggggagaacatgaaggattctgtgattcatatgatggaagaaaccatcgcagattatgtaaaccagtgtgccagtgaagatgcggcaccggaagaatgggatatggatacactgaatgcagagctgcgcccgattattccgtttggaaagatcgagctgacccaggaagagattcaggcaggaaaacctgagatgctcacaaagcgtctgcaggatgaggctgtagaattgtatgctcataaggaaacggaatttgaagactatgacctccgtgagattgaacggatcattctcctcaaggtcattgaccgcaagtggatggatcatatcgacgatatggaccagcttcgggagggtatcggcatgcaggcatacggacagagagatccggtagtggaataccgcatggccggttttgagatgttcaatgtgatgacgaaggcaatccaggaagagaccaccggagcactgttccacgtagagattgaacagaaagtggagaaagagcaggttgcccaggtaacaggtactaataaagatgacagcagcgtgaagatgccgtataagagaaaaggggagaagatcggaagaaacgatccgtgcccgtgcggaagcggaaagaaatataaaaactgttgtggaagaaattaaggagttttaggagtgattgaattagatcagttaaaatatagcctgaattcctaccgggagccgcttgagaaattaagcggttctcttggtttggaagaaaagaaagagcggatcgagcagctggagcttgatatggaagctccgggattctgggaggacctggaggagtcccagaaggtagtaagagaagtcaaagggctgaaggatcaggtggaaggatatgaagggctgaaaggacagtttgaggatatcgaaactctgatcgagatggcgtcggaggaagaggacgaagaactggctgcggaaactcaggaagcatttgcggagtttgagacagcctatgagaatctgcggatttcgactctcctgagtggggaatatgacaagaataatgcgatcctgagcctgcatgcgggggccggaggaaccgagtcctgtgactgggccggtatgctgtaccggatgtatacccgatgggccgggaaaaaaggattcgagacaaaagttattgactatttggacggggatgaggcaggaattaaatcagtgacggtagagatcaaaggtgaaaacgcctatggatatttaaggtccgagagaggcgttcaccggctggtgagaatttctccgtttaacgcggcgggaaagaggcagacctcttttgcatcctgtgacgtgatgccggagattgacgaagacctgaacgtggagatcgccgatgaagatatcaggattgatacttacagagcaagcggcgccggaggccagcatatcaataagacggattctgccataaggatcacgcacatcccgacagggatcgttgtccagtgtcagaatgaacggtcacagcataagaataaagaccaggcaatgaagatgctcaagacaaagctgtatctgttaaaagagcagcagcatctggagaaactttcggatatccggggagatgtgggagataatggctggggaagccagatccggtcctatgttctgcagccatacactatggtgaaggatcacaggacaaataaagaaagcggcaatccatccgctgtcctggacggagatctggacggtttcatgaacgcatacctggcatggagcaatgattgatttaaatttagtataaaattcctcatatggatttttgcatgtagattaataaaacacaaaggatggttttatatgaaaaatatcagaatatacacagggattctgctgacagcagtgatgattatgacattgtctgtatctgtttttgctcaaagtaatagggaacagaattatggagtttctcaggtcagtagttcttcagttcatgccagtgataagaaaaataatataatttttgaaaagaaaattaaagtaaagaaagttgatagtgttgctaaagcaggtgatttcacttctgcagaactggcaaaatatatttctctttctgctgcggcactgttgtgcatcatctggctgattgtcagatgcctgaagaagaaatagggaagagtttttgcagggcatacaatctgcacggttgtatgtccgttttttattcataggaaagttcgtcctatggaataaaaagccctgcggcaggatgcacagcttcgcgcgcggaacaaaagctgtgtttagaaaaaattggtttgcgatgtgtgcgaagcacacttttgttcttgaaacagttgcttaatttttaaaaatatgatagtatcttgtggaaaaacaattgtgtttaacacacgcacagaggtggactatgttagaagattcaaagtattatgtcattaaaaagaaagcggttccggaggttctgttaaaagtactggaagtgcagaagcttttggatgcagaacaggctaagtccattcaggaggccacggagactgtggggatcagccggagttcttattataagtacaaagatgatatttttccttttcatgcgagcaaaaagggacgaaatatcacgtttgtgatcgaggtggaagaccagccgggagttatggccacagtgcttcaggtatttgcaaactacaaggccaatatcctgacgatccatcagagtattccgatcaacggaaaaggagtgctcacagtcagcgtggatatcgttgacatggagactgatgtgtctgccatgatcgagagtgtggagaagcttgacaacattacatatgtaaaaataattgcaaaggagtagaacagatgataaatattgcggtattgggatacggaaccattggatcaggagttgtggaggtcatcgagacaaatcacgagagcatcaaccgtaagatcggggagccgatccgggtaaaatatgttttggataagagggatttatccggcacgccggtggcgtcaaaggcagtcacagactatgatatcattttaaatgatgacgatgtgagcatcgttgtggaagtcttaggcggagtggagcctgcatatacgtttgcaaagcaggcgctggagcacggaaagagcgttgccacttccaacaaggaactggtagctgaaaagggagcagaacttctggccatggcaaagtccaagaatttgaatttcctgtttgaggccagtgttggaggcggaattccgatcatccgtcccttaaaccagtctctgacagccgatgagatcaatgaaataacaggtatactgaatgggactacaaactatatcttaacaaagatggccgatgaaggggctgacttcgatgaggtgttaaaggacgctcaggagaaaggatatgcggaacttcatccggaggcggatgtggagggatatgatgcgtgcagaaagattgcaatcctgacttcactggcattcggcatgcaggtggattatgaggatgtacataccgagggtatcacaaagatcacagaaactgatatgaaatatgcaaaagccctgaataagagcattaagcttttgggaaccagcaaaaaaatcggtgacaatgtatatgccatggtatgcccgatgatgatcggcagggaccatccgctgatcggcgtcaacgatgtgttcaacggcatttttgtaaacggaaatgtcatcggcgacgtgatgttttacggagcgggggcaggaaagcttccgacagccagcgcggttgtggcagacgtgatcgatgcggcaaagcataaagagagaaatatcatgcagatctggagtgaaaagaagcttcatctcgcagatatcggcgattttgaacataaattctttgtgcgtcttccgaaagactgcgacagagaaaaagtaaaagaagtttttggtgatgtagaagaagtttcagcagaaggggtgacagatgaatttgcatttgttacactgacaatgaaagaaaaagactatcaggataagatcaaagcgtttaattccgttttgggcatgattcgtatgaatgttaaatagatttggaggactagtttatgaagtatattgttgtgttgggagacggaatggccgatgaaccgatcggtgagctgggcggcagaacaccgcttcaggcggccaggactccggtcatggataccatggcaaaggtatcggaacagggaattgcttacacggtgccaaagaaccttccggctggaagtgacgtggcaaaccttgctatgctcggctatgacccgcagaagtattattccgggagatcgcctcttgaggcgctttccatcggtgtggatatgaaggatactgacattgctctgcgctgcaacattgtcaccttatcagaagatgagacctatgaggaaaaaactatcatcgatcacagctccggggagatcacaacagaagaggcaagggttctgatcgatgcggtgaaaaaggaattagagacagatgagtttcagtattatccgggagtcagctaccgccatcttacgatctgggatcacggagagacggtggaactgacgccgccccatgatatattaggaaagcggatcggggagtatcttcctgaggagacaaagctccgggagatgatggagaagagttttgatattttagaccggcatccaatcaacgaaaaacgcagggagatgggattgaatccggcgaacagcatttggttctggggtgcgggcacccgtcctgcgctggatgattttgaggaaaaaacaggaaagaagggtgctatggtatccgctgtggatctgctgaaaggcatcgcggtcggtacgcacatgctgaatttagatgtggaaggagccacaggcggactcgataccaactataaaggaaaagcaatggcagccgtggattctctgacgaaagacggggcggatgtggtttatattcatgtggaagctcccgacgagatggggcaccagggaagtgtggaaaataaagtgaaggccattgaatttctcgatgaccaggtgatccgtgtcgtcgcagaggagctgaagaagcgcggagaagatttccgtatgctcattgggccggaccatccgacacccatttcgatccggacccattccaaagacccgattccgtttatgatctatgacagcacgaaggaaatgaagggacagaaggaatacagcgaagaggcagcaaaaagtacaggactcgtcctggaacacggacatgatctgatgggccggctattacaaaaataagagaaaattttaggaggcagcaatgttaattgttaaaaaattcggaggtacatccgtaggaaataaagagaggattttaaatgtggcaaaacgctgcattgaagaataccagaaaggaaatgacgtggttgttgtcttgtctgcaatgggcaagatgacagatgaactgatcgcgatggcgaaggatatcaatccgaatccgccgaagcgggagatggatatgcttctgactacaggagagcagacatccgttgccatgatggcgatggcgatgcactccatggggattccggctgtttccctgaatgcattccaggtagccatgcacacgacccacgcttacagcaacgccaggatcaagagaatcgatacggaccgcattcttaacgagctggaacagagaaaaatcgtcatcgtgacaggattccagggtgtggaccgttacgacaactatacgactttgggccgcggcggctcagacactactgccgttgccctggctgcggccctgaatgcggatgcctgcgagatctatacggatgtagacggtgtttacaccgcagatccaagaaaagtcactacggcgaagaaactccaggagatcacctacgatgagatgctggagatggccacactcggtgcgggagttctccataaccgttctgtggaactcgccaagaagcacggagtacagctggttgtccgttccagcctgacgaaagaagagggaacggttgtcaaagagaggatcatgatgcctcaggcagagatcagcggtgttgccggagacgatgatgcggcacggatctctgtgacgggactcgaggatgagccgggagtagcattccgcctgttcaatatccttgcaaagaagaatatcaatatcgacatcatactccagtccgtaggacagaacgcaaagaaagatatttcttttacggtgaaagaagacgatgcggatctggcagtcaaaacgatcaaagagcatctgccgctggggtcctatgcggatgtggatgctaccaccgacgtggccaaagtatccatcatcggaagcggactgatcggacactctggaatggctgcccgcatgtttgaggcactgtatgaggttggagtcaatatccggatgatctcaacatctgagatccgtgtgacggttatcgtggaccgggctgatatggtgaaggctatgaatgcggcacacgaagcatttgaattataacagaaggtgaaagggaacaccgcctgcagtccgggcggtgttttttgacccggaaggaaaggagatcaggatgaagagaacagattatttatcatgggatcagtatttcatgggggttgcgcttctctctgcccagaggagcaaggatgaccacacgcaggtcggggcatgtcttgtcaacgaccagaataaaatattatctgtgggctacaatgggatgccgaccggatgtcatgacgatgacatgccgtgggagcgggagggagaacctctcgatacaaaatacttttatgtctgtcatgcagaactcaatgccattttaaattacgggggaggctctctctatggagcgagagtctacgtaactttatttccgtgcaatgagtgtgccaaggccatcattcagagcggaatgaaggaagtgatttatatgcaggacaagtacgccgatgacgacatgacggttgcgtccaagaggatgtttgatatggccggtgtgaagtaccggaaatttgaaccaaaagaccagacaatagaactgcacttataaggaaatggaaaaatggatatcatcaatattttaaaagacgagctgggaatcaaaagagcacaggcggagacggcagtcaaactgattgacgaaggaaatacgataccgttcattgctcgctaccgaaaagagatgaccggctctttggacgacgagacactcaggaacctggacgagagactgaaatatttaagaaatcttcaggacagaaaggatgcggttttaaagagcattgaggagcagggaaagctgagtgaggagctgaaaaagcagattgaggaggcggtgaccttagtcactgtggaggacctgtaccggccgtataagcagaagaagcggaccagagctatgatcgcaagagaaaagggactaaaacctctggctgatctgatctttttacaggcttctgacgatcctgccagagaggctgaaaagtttattgatccggaaaaaggaacagagacaccggaagatgccctccagggagccaaagatattctcgcggagatgatctcggatgatgccaaataccgtgaatggatcagaagatcctataaagaacatggaaggattttgtccgctgctaaaaagcatggaaagaaatctgtctatgagatgtactatgactttgaagaaccggtaaaaaaagccgccggatacaggatattggctatgaaccgcggggagaaagaagggttcctttctgtaaagatcgagcctgacaatgaaaagatcgcggcttatttggtcagaaatgtggtgaagaagcagaagcatcccactacaaaatatttgctggaagcgatcgaggacagttataagaggctgatcgcaccttccatcgaaagggagatcagaaatgaattgacggaacaggcagagacggaggctatcaagcttttcggcaaaaatctggagcagctcctcatgcagccgcccatcacgggacaggtcgtcctcggatgggaccctgcgttccgaacgggatgtaaattggctgtggtggattcgacaggaaaagtcctggacacggtggtgatctatccgacggcgcctcagaacaaagtggaagaagccaaaaagacagtaaaaaacctgataaaaaaatatgggattacgctgatctcaataggaaacgggactgcctcaagagaatcagaacagattgtggtggaacttttaaaagagataaaagaaccggtacagtatgtgatcaccaatgaagccggggcttcagtctattctgcgagcaaactggcgacagaggaatttccgaatttcgatgtgggccagagaagcgcagcctcgattgcgagaagagttcaggacccgctctcggaactggtaaagatcgagccgaaagcgatcggtgtgggacaataccagcatgacatgaaccagaaacagctttccggggctctgacaggtgtcgtagaggcgacagtaaataaagtgggtgtagatttaaacacagcgtcagcttctctgcttgaatatgtgtccggtgtatctaaagcagtggcaaaaaacattgtctcttatcgggaagaaaacgggaaattcctgaacaggagagaactcttaaaagttgccaagctggggcccaaagcctatgaacagtgcgcgggatttttaagaatctccggcggaaagaatccgctggatgccaccggagtgcatcctgagacttataaagagacagatcagcttctgcagagtcttggctactccgtgaaagaactttccagtcagggatttcaggatataggaaagaagattacagactatcaaagactgtccgaggaactgggtgtgggagagatcacactccgggacattgtgaaggaactggagaagccggggcgtgatccgagagaggatatgccgaaaccgattttaaggacggacgtcatggagatggaagacctgaaggaaggcatgaagctgaaaggcaccgtgagaaatgtcatcgacttcggagcctttgtggacatcggagtccatcaggatgggctggtgcacatctcccagatggccgaccgttttgtaaaacatcctctggaagtggtcagtgtgggcgatgtggtggacgtgaccgtgctgagtgtggatctggagaaaaagagaatacagctttctatgagaaagtcctgatttaccagcctccggagaaggtgatgatctctcccgtcagataccggggagctgtgcaggtgtgatagatcatctctgcggcttccctgggaccggcaatccggtctgccggtatctcctgccggatcatgtctttttcttcttcggtgaatccggagttcatttctgtgtcaatcatgccgaacgctactgcgttcacggagatattgctgggggcaacctcttttgccagggctttcgtaaacgtattgacagcgcctttggcggcagagtacagcacctcacaggaggcgcctgcgccgccccatacggaagatatgttgaggatcgtaccggactgccggcggatcatatgaggaaggacacttttgcaggaggcaaacagcggcatcacattggtgtggaacatttcctgccagtctttttcagaggtatcagtaaacagacccaccctggaaatacctgcattattcacaaggcagtccagccctccgaaacaggagatagttcctgctatcatctgttccacaaaataggaatcacagatatcgcctgtaaaagaaagacattggacacccagccttttgatctcttgttcaagagatgcgaggcgttcgggatgacggtaaccgtggatggccacattccagccgttttgggcaaagaccagagccgtttctctgccgatgcctctggaactgcctgtgatgagtactgtattcatagcttctcctcctggatttaagaaaactttaaggagagtatagcatatagttttgttgaaataaatcgatttatttggtatactgaacggagtttcaagggaaggagcatgggaaatggccagaagagcaaggagaaaagcaggagccggggcgatcatcctgcggatattggtagtcattgtactgtcagcggcggtaggaatcggttcttttgcaggaagtaaagcattttttctgaatagatttaaaaaggacaaaaaagataagatagcggaggcgttaaaggcagagagccaggaaagagtagatgtatccctggtgagagtaaaagatgccttatcgatccgcatctatcataacaaggataaacagatggttttcgtaccgatcagaaaggacaccatactgactctggacaacgacggagtcaaagccatgggcggagacacgaagacggccaccgttgagcagctggcagcaaaggccaaggatatcaaagtcatcaaggcgcaggtagagaagactctgggaattaccatcggcagctatgagagcttgtcacagaagaatttcacaaaggcagtgaacaatgccggagaagtagaactggatctcgaaaatgaagtggcatacaaagaccagaacaagatgctggttcatattcctgcggggaataacacaatcaacggaaatcaggcactgggaatgatcctggacagcagccagttcagcgacgagaatgagcacatcgcgctggttggggaactgactgttaagatagcccagagcatcaacaagaagtcattaaacgactataaaaagtttgcgaaagattattatggcagttatgcaaagagcaatgtgtcatacgacagcatcaaagacaatctgagcaggatgcatgaggtcagcgctaaggacgttacctatcagatcctgtccggctccgacgaaggggaaaactttaagctggatacaaagaagacgaaagagatgtttgatgaactcctctcagaaaacgggaaagttccggaatcatccggctcagagaaatctacaaagaaggaaaaaacaacaacggaaaagaaaaaagagacagaagtgtcttccaagggaatctctattgagattcagaattccacgaggatcagcggccttgcgggaagctggaaagacaagctttcgggagacggattcacggttggaagcattaagacgaaccggcagggaacactgacagacacaaagattatcgttgcgaaaaagggtatgggcgaagacctgaagaagtattttaaaaatccaacgattgaagtcggaagcgtggacagcggtgcgcagatctgcatcatcctcggaaccaacgatgatatttagcaggacagaataaagggtttaaaagaggccatactaacataaacgatgatgtttatgttaggaggcgtccggtgaaacgaaaagaagcattcagtattataatcggaacattttgcatggcagcagctaccaatacagtattccagccgttcggaatcgtcacaggcggtttcggcggacttgggatcatctttgacaagctgtggagcatccctctgtggatgacgaacgtcacgctgaatgttcctctttttatacttgcattccgctataagacaaaaaaatttatgctcagaactatatgcagcgatattatgctgaccgtctttttaggtgttctgcctagattctcatttttcccgaaagatttttatgtcaatctgattctgggggccatcctgatgggaatcgggcttgggctggtgatgaaggaaaggacatccacgggggggacggatctgatggcgttcttactgcatgttgtctttccgcatgtaagcattcctatgcttcttgggatgctggacggcacgatcgtcctgttcggcgcttttattttcggtgttgagaaaacaagttttgcgcttcttgtcatatatgggattacgaagatcacagacagtgtggtcgaaggctttcaggtttccaagctggtgtttgtgatcagccggcatcaggaacagatatcggaacagattttgtttcgcatgggccggggagcgaccaagctttcttctgtgggagcttataccggacagagcaaagaaactctgatgtgcatcgtatcaaagaaggaagtgcctgtgctaaagaagatcgtcatggaaacagacccgaaagcctttgtgattatatctgacacaagagagacaataggggaggggtttgtggattatacacaataaaataaaaaagttactatctttctcttttttttttgtatattttgctatatagtattagaaaaggtcggaaataagaaagggcgtgtaaatatgatttcaaatcaaatcctgcaggagacattagatggaatacacagtatttccaacgtggatctgtatgtgatagatttaaacggaaagatcctggcaaaaacgaaggagacggaggcagaggatgaagatacactgaagggcttcatcaattccgtagcagagagccaggttgttggcggcaagcagtattttaaaatttttgacgacaaacgtctggagtatgtgcttttagctgacggagagagtgagagcatgtatatggtggcaaagatggcggtgtttcagattgaaagtctgcttgtcgcctacaaagaaaggtttgacaaggataattttataaaaaatcttcttctcgacaatctgcttctggtggatatctataaccgggccaagaagctgaatattgacatcgaggccacacgggtcgcctatctgatcgaagctacctatggcaaagatcaaaatctggtggaaacagtaaagcagctggaggatactacggatgatgactttattgccgccgtcgatgaaaaaagtatcgtattggtgaaggaagtctgcgtaaaggcccagtcaaagcagtttgtcaagacggctgagaagcttctgaaaaacctgaaaaatgtcgggatcaatgacgcgagaattgccgtggggaccatagccaaagggatcaaggatgtgtcccggtcttacaaggaggcacagattgctcttgaggtagataagattttctatgaaaacaaagaagtggtagcctatgaccagctgggtatcggaagactgatctatcagctgcctctgccgctttgcaaaatgtttatcaaagaggtgtttggggattattctccggaggagatcgacgatgagacattggcgacgatctacaagttttttgagaataatctgaatgtctccgagacgtccagacagttatatatacatagaaatactcttgtataccgcctggataaaatacagaagagcacgaacctggacctgaggaattttgaggatgccattgcttttaaaattgctctgatggtcgtacagtatatgaagcatatgaatacacttggataaacgtgtgagaggggagtcatttctatgattacactgcagaatgtgacgaaagagtaccaaaaaggcagcatagggctggacaacgtgtcactggaggtagataagggggaatttgccttcatagtgggtaagagcgggtccggcaagacaacactgatcaagctgctgttaaaggaactggaagcgacatccggggatatcgttgtcaacggctatcactaccagaagatgaagcggaggcagattccgtatctcaggagacaaataggcgttgttttccaggatttccgactgcttagagaccggagtatctatgagaatgtagcgtttgcgcagcaggtgattgaggtgccgaaaagagccatgaagcggcaggttcagaacgtccttgagctggtggggctggggaacaggctcagggctctgcctgacgaactgtcaggaggtgagcagcagagggttgccattgccagggctttggtcaatcacccggcgcttttgctggcagatgaacctacggggaatctggacccgcagaatgcacaggagatcatggatcttctggtggaaatccagaagagaggaacgacagtgattgtcgtaacccataataaagaaatcgtaaatcatatgggaaaacgggtcatcgccttgaatgagggagcagtacatcacgacgagaaaggcggtacatatgatatttagacggctggcctatgggtttaaagaagggctgaaaaatattttcaggaacaaaattttttctttggcaacggtagggacgatcatggcctgtattttccttctgggagtgacattttccgtgctcctcaatgtaagggctacggtaaagcaggcagaagattcagtgaccatttccgtattcttcgatgaaaagctggcggagagcaggaaggatgccatcggaaagaaaatcaaaggttacaaagaagttcagtctgtccgttatgtatcggcggaagaagcatgggctaagtataaaaaagaggtattcaagaacaatgaagatcttttggagggatttgagggcaaaaacccgttaaatgaatcggactcctatgaagtcatgttaaaagacgtgaagtatcacggaaaaatggtcaggcagtttaaaggcctggacggagtgagaaaagtagagtatgcaaaaggtgccgcagaggggatttccaaggcaaatcttcttggagcctatgtggcaggggctattatcctgattcttttgcttgtgtcggtcttcctcgtgagcaacaccgtctctatcggtattgcggtgagaaaagaagagatcgccattatgagactgatcggtgccaccaaccggtttatcagggctccgtttattgtggagggagccgtcataggaatcgtcggctctctgatccctatgggcgtcatttatataggctataaggtgatagtcaactatattatagacaaatttcatgtactgacaaattttatggagtttgtacctgtaaatcagatcatggtttatctgattcctgcgtctctgttagtggggctcggcatcggatgtctcggaagcagctttacgatccgcaaatacctgagagtgtaggaggattcctatgaagaaaaaatattttggtgtaacagtatttcttttgaccctgtgtctttgctttgccagcctgccgggattggcggtgaaggctgacagcaggacggaagacttgaaggataaggcaaagaaaaaagaagaggaaaataaggagctggaaaagaagatttccgggatggaaaaggaaatcgaggccatggatcagaagatcgagaaggcttccgataaagcggacaagctggaaaaaaagctgaatgacacgaagaagcaggtgagtgatacaaaagaaaagctcagtgaggcaaaggcatccaaagaaaagcagtataagattatgagcaaacggataaaatacctttacgaaaatagaaacacaggttatattgatgtgattgtacaggcaaaatcttttaatgagttccttacaagacttgactatgtgtcaaagatttctaattatgacaataatatgtttcacaggctcagaaaaactcaggacaagattgccttagcttcaaaaaagctggaggaaagctacaaggagattaaaactgtgacgaaggaagccaaggctgaagaggccaagattgtcagcctggccgacagcaagaaatccaagctgatacagttccagcagaagattgcatcaaacaaggatctgatgcagaagtatcaggaccgtatagattactacgatactgcatcaaacaagccgtccggaggaaacgcagggaatagttcttcatccggaagttccagacccgggggcagttcttcgggaagctccggcggatcatcctccggaaatcacagttccgggggcggatcttcttcactgacatggccggtcccgtcctgccatacagttacttcaccatttggaaaccggacacatccggttcaggggggaacgaaattccatgaaggcattgatatcggagcgccaaagggttccacggtagtagcagcgggaagcggtacagtggaagtggcaggatacagcccgtataacggaaactgggtgaagattgaccacggaaacggactggagacattgtatttacataattcttctctgaaagtctcgtccggacagagagtcagcagagggcagaagatcgcgtcatccggctccaccgggatgtccaccgggccgcatcttcactttgcagtaaagaaaaacggcagctatgtgaatccaatgaattatatgtgacaggaactgtggaatcaggggtatgaaaaaaagtcatacctctgttctttttatatatgaaatttccatagtataatggatttaaatggatatcatgggaaaggagcggagtatgaatttaaaacagctgacctattttgttgcactggcaaagaatcaaaattttaccactgccgcaaatgaattgtttatctgccagtcggcactgagcaagacgattaaagccatggaagaggatttggatgtacagctcgttgaccggactgcgaaacgcttttgtctgacgccggagggcaggatgctttatcaggaaggcagagatgcactggagagcatcaacaaccagatggagcatttaagagactgtattaatgcagagaacggggaaatttccgtgggaatacctccggtgatcagcacgatttattttgcgtctattatccaggggtttcgaaaagcctatccgggaatccgccttgtaattgcggaagagggagcaaatactgtgaaagaaaaggttcagtccggagagattgacatcggtgtggtcatacttccttttgcttcggacgattttcatatccttcctgtatttaagtcggacaatgtgctgacggtcagcacggatcatccttttgcgggccgtgagaaagcagcttttcgggagttaagaaatgaagagtttatttcacttgacaagacatttatgctccacagccggaccagggaactgtgccatatgtcgggctttgagccgaacatcgttatggagagttcccagtgggacttcgtggccgagatggtttcgctgaatcagggagtggccattcttccgcggccgatcttatcccgttttaattcagataaaataaaaattcttacactgacggaaccggagtttccatgggatatagcattgatcataagaaaggacaaatacgtttcaaatccgatcagacattttcagacgtatgtcaaagaacacgggaatattaaataaagaaattgcaaagaactaaaccttagatgatagagaggcttagttctttttttcatgccgtctatgaattttatatattttactgtgagaatcaaccaaacctataatggatttatagaaatgattatacaagatgatcagagaattgcatcaggaaaggagtaaccaatgggaaattgttcattaaaggtcggagatgaatgttctttttgtaaacaaatcagcaatgaggatgtcctggcatttgcagaggtgacgggggataagaatccgctgcatctggatgatgactatgcgaaagatacggtatttaaagagaggatagctcatgggatgatcagtgccggagttatctcggcggccattgccatgaagcttccgggacccggtaccacatatctgggtcagtctctgaaatttacaggacctgtgaagattggagacacagtcacagccagtctgagggtaaaggaattaaaagaaaaaactaagtttacgatcgccaccattactacgacttgtgtcaatcaggaaggcagggttgtcgtggaaggggaagcaaccgttattccgccggagcataaggaggatacagcatgtctaaattaagcagtgcagaagaggcagtaaaacagatcaaagacggcgacacggtagcgttcaacggatttgctttcggattcgggttcgctgaagaaatagcaaaggccttgggaaaacgctatgaggaggaggggcatccaaaagaattgacgctcctgtttggatcgggctgcggagacggaggagcccttaaagaggatttcggccttgaccatttggcaaaagagggaatggtcaaacgaatcatcgccgggcatgtgggactggcaaagaagctgagcaggatgatcaatgagaataagatcgcagcttataattttccgcagggtgtcgttgcacatttattcagggccattgcaggcggcaagcccggggtgctgactcaggtgggattaaaaacatttgcagatccaagagtggaaggcggccgcatgaaccaggctgctcaaggcgagagctttgtggaggttatggaggcagcagggaaagaatatcttctgtaccgttccattcctgtggacgtcgccatcatccgcggcacggtgggagacgagaaagggaatatgacggtcgataaagaaggcgtgcttttggaaacacttcatatcgctgaggcagccagaaattccggcggaatcgtgatcggccaggtaaaagaggtggcaaaagaggggactttggacccaagagagatatatgtcccgggaatcatggttgatacattggtcaaagctaaaccagaaaatcaccgtatgacttgtattcttgactatgatgcgtcttttacgggagaagtaaaagtgccgtctgacagcattgctcccatggaaatgggaatacggaaggtcatcgcaaagcggtgcgccaaagagcttcagctggatactacgattaatctggggatcggggtaccggaaggggtcgcatccgttgccctggaagcagggatcgcagaccgtctgacaatgacgatcgaggccggagcgatcggaggcgtgcctcagggagggcacagccttggagctgctgccaacgtagaggtgctgatcggccagccgaatctgtttgacttttatgacggcggcggacttgacctgacctgcctggggcttgcacaggctgatgccaaaggaaatatcaatgtaagcaagtttaacggcaggatggttggctgcggaggattcgtaaatatttcacagaatacgaaaaacgtcattttctgcggtacatttacggccggaaagtcgctgatcgaagtaaaagaccggggacttcagatcgtacaggacggtgagtttaccaagtttgtggaccgcgtggagcagattaccttcagcggagaatatggcgtgcagaccggccagaatgtgctgtatgtgacggaacgggcggtgttcagactgacggaaggcggtctggaactaattgagacagcacctggaatcgatctggaaaagcacattttagacaagatggatttcaaacctttgatatcacggaatctaaaagagatggatgcagatatatttgacaacaccccattaaagatcggaggcagatagtatgattggaattgttttagggcttgcgctgctggtattcctggcgtacaagggatattcaattatctgggtggctccggtatccgctatggttgtggcgctgaccgggggactttctctgctacctgcatatacagacacctatatgcaggggcttgtagattttgccaaatcctggtttccaatgtttcttttgggagcgattttcggaaaggcgatggaagttacgggggcggctcattctgtggcaaaaaaattgtcctcaatgatcggagcccagagggcaatcctggcggtgattatcagctgcggtattttggtctatggcggaatttcactgtttgtggttgtgtttgccatttatccgattgccgtatccttattccgggaggctgatcttccgagaagactgatcccagggtgtattgcctgcggtgcattcacattttccatgaccgcatttcccggcaatccccagctgaataatatcattcccacaaaatatttcgggacgaacgcaatgtccgggcccgtcatgggtattgcgggcgggctcgtcatgcttgtgggaggttatctgtggctgtcttaccgcgcaaagaaaatgactgccgctggagaacactttgatgaacctgacaatataaaggagagtgcttcagaggatctgcccaatccgctgctgtcggttgtgccactgctgatcgttgtggcatcactgaatgttctgccgatgtggatcgcgtttccggaagataagaagtctacttacgccatcatcattgccctgctcctggggatcgccgcgtctgttcttttaaatctgcggaatttgaaggacatcattggcgctgtcagtgaaggtgccaacggatctgtcatggcgatcatgaacacatctgcggctgtgggattcggtgccgtggtgaaagcggctcccggatttgccgtgcttacaaaggctgtcctgggcatcaaagcaagtcctctcatttcggaggcgctggctgtaacacttctggccggagctaccggatcatcctccggaggcatgggcatcgcgctggaagcattggggccgaaatatatggagatggccacatctttgaacattgatccgggtgctttccaccgtgttgcatccatcgcatccgggggactggattctctgccgcactgcggggctgtcatcacactgctggccgtagcgggaatgacacataaaaaatcttatgcagatatcggaatggttacctgtgtgattccgattgtggcaaccgtagttgttgtggcgatggggatgatgggaatagtgtgacattttgtacatgatttccgttcggctcttagaatgcctcactccaatcatgtacaaaatgagcgtaatatctgccggataagtaatttgtttaatagctcttttttactgaaggtatatcctgcattgttttgcaaaggcaaagattgaataaaaatgaaagtaaatgcagagtttaagagaagccgtgatgaaaaatcatggcttttctcatgggaaaattagccggatatgtcggttaggtttatgcattgctgtttagttgagggttgtagcggctttttctcagtgttataatggaacacatatttggaggatgctctttgtttacaaagagatatccggacgtggaggtcgaaatgaaaaaacaattctcaaaaatcttgattgcagttctgcttgtgatctctctcggagagggatttcttttatacaggacatattcggtatcgggagaaaatgtggagatcgcaaataaactgcagcgccttaaaaagaccgtggatcaatactataccggcgatgtggatgaggagcagctggaaaattatacttataaaggatatctggcaggtctgggagacccatattccacttattattcagagagtgaatttaaagaactgatggacgcgacgaacggtgtattttcaggtgtgggaatttatctttcccaggatattgtcacaggtgagatcaaggtgatcagggtcatcaagggtggtcccagtgacggaagcggaatcaaggccggagacgttctgatcaaagtggacggcaaatctgtcggtgacaaggatctggataaggtcgtggcagaagtaaaaggagaagaaggcacgaaggtaaaactttcttttctgcgcggaaaagaaaagaaagtaaaaaactacacaattacgagaaaaaaggttgtgactcagactgttgagacaaaaatgctcgatgatggtattggctatttgtctatctctgaatttgacgaagtgaccgttggccaatttaagaaaggcattaaacagctgcagagcaaagggatgaaggctttaattctggatgtccggaataatccgggcggactggtggattctgtagtggatatctgcgatgaactgcttggtgaaggcaggattgtgtctataaaggataaacagggcaaggaaaaggtacaccgttcagatgcagagcagtcggtaaaagttccggtctgtgtccttgtgaacggagagagcgccagcgcatctgagatcttgtcaggagctgtgaaagatcataagaggggaaccttagtaggggaaaagaccttcggaaaagggattgtgcagggattctttaaattgggagacggttcctatgcaaaattaacctatgcgtcatattatacgccgtcaggagcaaatatccataagaaggggataaaacctaatgtaaacataaaagatgacaccaagacaaaagcggatgaacagcttttaagagcgcagcagattttaaagaagaagctgaagaaataaaattttacaggaaccggaaaaggaacgaaagcatgagaacgaaaaaggatggatttaccttagtggaactgatcgtggttttgctgattctggctatactgatcgcggtgctgatcccctcactgacagggtatatcagaaaagccagggagaaagcagctgtagctgaatgcagaaattgtgtccaggcggctcaggcaatactttcggagcagtatggagaacatggcgccggaacattgtccgctccgtacagtgacgttcttgcgcaggcagaagaaaaaggaacgatccgggaaatacggtttaacagtgactgtaaggtgacttatctgaaatatacgtctaaggcagagattaccgtgatttatgagaatgaaacttacaggattgaaaaagacggcggaccggaagagggtgaagaatcttcaaatggaagtgtcacgattaccgacagcagcggaaaaaaacatgagcttgggacatccgaagatgcatgggaacagaaaaaagacgcaatcaacaacgagtatggagcagggttcggaaacggttttttgtatcaggacaaaaccggactgtacgcttcggtcaatgacccatatttcggaaccgataagaataaggatttgacattggcagatctggccgcgcaaaatccgaatcagctgataaaaattgattccaacaccagactattcattgaggcagatacagagaacgcgtcaggtccttacttaaagggcgtaaagagaggcgacctgtgttttgtgaacggaaattactacattgctcccggaaatatcggagagtgggaaaagccgggtcagggaagctggattaagcttaagttctgatcataaaggctgattaagaggacttcctgagcagcattgctttgggagtctttttgtttgcctttggaccagaactgtgataaaatttattaatatatatatgagcagagtttggagctgaagagtctttcataaatctgctgaaaaaggggagagcagaatatattatgaggagcaacaaatatgagttcagatgaaagaatttacaggctcgtcttcgagtattatgaagccaggattctttatggatactataaatacggggaaaatctgccgtcgatatcgaaaatctgtgctgtatttcacatggctccggccacggtccgtgcgggcttgtcagtattggaaaaacaggggtacataaaaatcgatgccagaaaagcatcgaaagtgatttataagtcaaatccggaaatgcgcagaaggagtgccgctgaatattttgtaccgagaaagaaggcaatacaggatcttcttatgtccagtgaactgctgtttgaatcgtgccgggtactcgaattgaatcagtcaaatttcggggaatgggaaaagttcagaccttcattcgaacaaaatactgatcatacggtacccgtcaccttccagttctgtctaatggcactgcgtgccctggataacagtctgatcctgaatctttactgggaggtccttcgatttctgaagtttccgtacttagcggaggacgagatgcggaatattcggcaggaaaattttgagggaaagtctaaatccgagtgtattgttatgcttacgggttattttaaggactgctttcataaatcggtaaaaaggctgtttgattttatagatgaagcccagagagagtttgaattggagcagacagaaacattctcttttcagtggaatatttaccggcagagaccgcagttttgctataccttagtctgcagtgtgataagagatattaaaaatggaatatatacaaaaggaagctttctgccgtctctgccgaagatggcaaagtattataaggtctctgtcagtactgtgcggcggtcgttaagtatcctaagcagcgccggactcacaaaatcttttcagggcaaggggactcaggtccttcccgaagccgtacaggcagacatcggacgcccggagattcaggacggcctcaggatgtatcaggagagccttcagttattaaaactaacgataaaaaacgttctgctcaggacattgggctgtgcaccggacacccaaaaacaaaaatttgcaaaaagattttctgaacttgtaaaagcggaaaagggatatttgtgcattgagatctgccttgcattcatagaggaagaatgtcctttatcggggataaaggaatgttacagaaaactgcgggaactgactgcgtggggatatccgtttgccgttcatcgtctgaaggatgaagcatactatgaagcattccagaaaataatggaacatgccgccgggcatctcggaagagatgagatttccggatttgcagactgccttgaaatgctgcttcaacaggaagaaaaaaatataagagaaattgccgtagattgatcaggataagagctcccatggaataaaaatgttctgggggctgtgcacagatgcatgaggaaagggatttgtatgctatctcaaaaaaagatattagtagtggaagataatgaactgaaccgccagctgctgtgccagatactgggttctgagtatgatgttctcgaggcagaaaacggagaagaggccctggaagtattaaaacagtatggggagggtatttcactgattcttcttgacattgtcatgccggttatggacggatatacatttttatctgttatgaaagagaattcggagtattcctcaatcccggtgatcgtaacgactcaaaatgatgcagagtccgacgaactggcagcattatctcatggggcttctgattttgtggccaagccttacagaccccagatcatcctgcaccgtgtggccggccttatcaatctgagggagaccgctgccgtggtgaatcaggtgaaatacgaccgtctgacgggactgtacagtaaggagtttttttatcagcttatgaaggatatactgatgcggaatccggacgacaggtatgatgtcatatgttctgatatcgaaaattttaaacttatcaatgatgtatttggaaacactactggagaccagctgctctgcggcattgcacatatgtatgagcaggaagtgaaggggatgggaatctgcggaaggctgaatgcagaccagtttgtctgtatgatagaacatagggaagattacagagatgatattttccggaaagccaatgaacagattaataatcttctggacggcgggacgattgtgatgaagtggggaatttactcggcggcggaccggatgctgtctgctgagcagatgtgtgaccgggcacttctggctgcccgcagtattaaaggacagtatggaaaatattatgcattatacgacgataaacttcgcagcagtcttctgcatgaccaggccatcgcggacagtatggaggacgccctgtccggagaccagtttcagatctatctacagcccaaataccggattatagacggagctctggccggggcagaggcattggtgcgctgggaacacccggagtggggagtccagtcaccggcaaattttattcctctttttgagaaaaacggatttataacgaaaatggaccaatatgtttgggagaagacatgcagagtgcttcaggaatgggaagacaagggttatccacagattccggtatctgtaaatgtttcaagggcagatatttttaacgcagatttatcctgtattctccagagatccgtcaaaaaatacggactgcacccttccaggctgcatttggagattacagagagtgcatacacagaaaccccttcccagatcatagataccgttgcgcatctgagggagatgggatttgtgatagaaatggatgatttcgggagcggttattcttcactgaacatgctgaacaatctgcccatcgatatactcaagctggatatgcagtttatccagagcgaaacggccaagccagtcagccagggaatcatgaaatttattatcagtctggcacgatggatgcatctgagtgttgtggcggaaggggttgagacgaaggagcagctgtccagactggaagaggctggatgcgattatgtgcagggttattattttgcaaagcctatgccgtgccgtgagtttgaaaagctgctggcagaggagtctgtcagtacattgttcaaaaacaaaaaagaggagtctgagccggaggaaaagaaagaagtcctgatccttgccgaagaggacagtaccttcagaaaacagataaagagcgggcttaaaaaggagttctgcgtgttcgaagcctgtgacggcagagaagtcctgcgtcttttgtcatggtataaaaaaaggatcgccggtgttatattgagtcttacactgccggggccggatgtgctggctgtggcagagcagatgaagagagacagggatcttgaaagtataccggtcattgtctcctcagagccggacccggaagcagaggagaaagccctggaggctggagcagatgattttatcggcagtccatttgccgtgaaaagtttgctgaaaaggctccggagaacccgtgaggccattcatctgcgtgctcgtgaagaactatttcaggcagatcagggattgtaccacgggaaagaagaaggcagagaaagctgcagtttatggggggaagaaggatatggaggaacaaagaaacgcatctgaagctgtacgggatttatgcagatgctggttcgagcagcgggatgcagaaaaaacagccggatatctgtctgaggatatcagtttcatcggaaccggagaaagagaatatgcctttggcagggaagaaatggttcggtatctgcatcaggatattgaggagatacccgagccgttcaaaataagcatttctgtggtttgcgaacaggtgctcggcgaaggtgtcgtcatgatttctcaggaaatgatactttccaactccgtttacgcatggagtctgagggggctgtttaatctggagcagaccagggagagctggcttgtgcggagtattcatttttcggagtcggcggtgagtcagggggaagcagagcattatccgaaaacactggtggtggagaatttgtcttcccagcgtcagcagatcttgaacgattcacttgcaggagggatgatcggcggatacctggaaacaggatttccattttattttataaaccgcagaatgttaagttatcttggatatgacagagaagacgaattcatttctgatatacagggcatgctgcccaacagcatacaccccggggaccgggagaaagccgtcgccgatgctaaatccagctggatggcggagacgaatatacactggaataccgtatgagaaaaaaagacggttcctatatatgggtgcacgatgttgcacataaggttgtgacagaagatgaccgtgatgccattatatcggtctgtattgatgttacggcacagaaaaaggcccagaacgagattgtacatatttacaataatatccccggtgccgtgtttcgctgccggtttgatgataagttttctgtcatagcggcgaatgacgggctgtttgatttcataggttatacccgcgaagaatttgccgccatgggaaatcatatggcagcagtgattcatccagatgatatggccgtaatgaaagaaaaactgcaggaacagctgaaatacggcagcacgatccacaatgagaacaggctgatccgtaaagatggagagatcgtatggatttcgatccaggcgcagctgtttacggaagaagatggagaacatcatttttactgtgtattcgttgacattacggaagaaaagcttttgcaggacagagtcagggaagtatatgagaaggaactggcttattttgcagatatgtcattgaatggaggcagcatccagggaagaatgaatgtaacgcagaatgttgtggagaactatgtggcatctgaggaagccggagtgacggagattggcaggagttatcagtatacgatagaaaaggtggcagagtcagcatcagatcccgtctacggcaatcaaatcagagaagaaatgcggcgggaaaaagttatagcagactatgcggcgggaaaggtggattataattttcattatctcagaaaacgcagcgacggcagtgtgttctggagcagtacgaacttccgatcttatctaaatccggaaacaggagatatcatcattttcttctacacttcagatgagacggagcagaaaatgcaggagaaactgctcagtaagattacagatctggactatgatatgatcgccgacattgatattgtaaaggacaattaccgcctgctttcctttgatctgaaggcaaataatacgataccaatgcagggaaaatttcagcaggagatccgcggtcttgcaaaccgttttatggatgaggaagcccggaggatttatctgggtaatcttgactacaactacatgattcgcaaactgttagaagatgaatcttattcttttatgatggaaatgagggatcagcaggggaatcttcaggtgaagcggtgtgaagttttctacattgacagggatctcggacgtgtctgccttgccagggtcgatgtgacagagattgtgagacaggaacagcggcagaaacaggaactggccgctgcgctggccggtgccgagcaggccaatgcggctaaatctgattttctgtcccgtatgagccatgaaatccgaacgccgatgaatgcaatcattggaatgtgcaccatagcggctcagtctatcggcaatgaaactaaagtggaggactgtatttcaaagattggaatttcatccaggtaccttctgtctttaatcaatgacatcttagacatgagccggatcgagagcggaaagatgctgctgaaaaatgaaaagattccgatggaggagtttataaacggcatcaattccatctgttatgcccaggcagatgcaaaaggcgttgattatgactgcgtcgtagatccgatgatcgatgattactatattggagacgcaatgaagctccagcaggttttgatcaatattatcgggaatgcggtcaagtttaccgaggagggcggaaaaatcacgttttctacgctgcgcctcaaaaaaacgaaaaatgatgtgactctgcgtttcataataaatgacaccggagtgggaatggatgaagagtttcttccccacatttttgaaacattttcacaggagagtaccgggattacttctgtctatggcggcacggggcttggactcgccatttctaaaagcatcgtggatatgatggacggaaggattaacgtgcgctccataaaaggggtgggatcagaatttaccgtggatgtgaagcttggaatcacagaagaagaaaaactgcgtcatcatcagaaacagcatagctataattttgatcacctcagtacgcttgtggtggacgatgatgtgactgtatgcgagagtgcggtagtgactttaaaagaaatggggatcaaggcagagtgggtagacagcggatacaaagcggtggaacgggtacggcacctgtgggatatcggtaattattttgacatgattctcattgactggaagatgccggagatggacggtattgaaaccgcccgccgtctgcgcaggattgtaggccctgaagtaacgatcatcatcatgacagcatatgactggatttccatcgaacaggaagctaagaccgcaggggtcaatcttcttatgagcaagccgatgtttaaatcttctctgatttcagcttttacaaaagtgctcgggcaaaaagaggaagaaaaaattccggaagaaaaaatagattttgagtttaacggcaggaggattcttctggttgaggacaacgcactgaatacggaaattgcaaagatgctgctggaagtaaagggatttgccgttgaaacggcagaaaatggtcttcgtgccatggaaatgttcagtaaatccgagcaggggcattacgatgcgatcctcatggatatccggatgccgatcatggatggtcttgctgctgctgccaatatccggaatttgagcaacgaagatgctcaggatattccgatcatagccatgacagccaatgcattcgacgatgatgtggagaaaagtaaggcggctgggatgaatgctcatctggcgaagccaatcgagccggacagattatacaggacattatatgattttatatacggcggtgaagaataggcatattcaaatttgatagtacagaacaaacattcgaatttgttctgtacttttttcgtggggtctgatataatcaagtctgatacacagagtatgacattttccacatgatttccgttcggctcttagaatgcctcactccaatcatgtggaaaatggacatattatctgctggagcaggctgcttagaagtcaaaggtgccacttttcgaaagttatttaccgctattggaggagcgcatttctaagcgcgcctaccctaagggtataaagtgcagtgtgccctgtgggtatgatatttcagtgaatgggaatcataattatgggaatttctatcccttttttcaatatacggaggtgtatatttatggatcattttgaattggtatctgaatttgagcctaccggggatcagccggaagcgatcagacagctggtttccggatttaagcaggggaatcagtttgaaacgctgttaggggttacaggttcaggaaaaacgtttacaatggcaaatgtcattcaggaattaaataaacctacactgatcattgcccataacaagactctggcagcacagctctacagtgaatttaaagcattttttccacataatgcggtggaatattttgtgagttactatgattattatcagccggaggcctatgtgccttccacagatacctatattgaaaaagactcttccgtcaacgatgagattgataaactgagacacagcgccacagccgctctcatagagaggaaggatgtgatcgtagtatccagtgtttcctgtatctacgggataggaagcaaggaaaattactctgagatgatgatttccttaagacccggtatggagaaggacagggatcaggtgatcgatgaactgatcaatattcagtacgtccgaaacgaactggattttaaaaggggaaccttccgggtgaaaggtgatgttctggagattcttccggtctctacatttgaggaggctgtccgggtagagttttttggagacgagatcgacaggatcgtggaatttgatgttctcacgggagaggtcaagagaagcattaactttctcgccatatttcctgcatcccactacgtagtgcctcaggaacagattgagcaggccatcgtcaatatcaaacaggagctggccgagagggtgaaatattttcaggaaaatgaccagctgatcgaggcacagaggattgcggaacgaacgaattttgatatagagatgctgagggagaccgggttctgttccggcatcgagaattattccaggcatctgaccgggggtaaaccaggggaaccgccaagcacgctgatcgatttctttggggatgattttctcgtgatcgtggacgagtcccatatcacagtgccgcagatcggcggaatgtattccggagatcagtccagaaagtctaccctggtggatttcggattccgtctgccgtccgcgaaggataaccgaccgctggaattcagcgaatttgagagcaagatcgatcagatgatgtttgtttccgcaacgccgagcaagtatgaagcagagcatgaacttctcagggcagaacagatcatccgcccgaccggacttttagatccgccgatcgatgtgcgtccggtaaaaggacagattgacgaccttttatctgaagtgcataaagagacggaacagggacataaagttctggttaccactctcacaaagcggatggcggaggagctgaccgattacatgagggaggttggaatccgtgttaaatatctgcattctgatattgatactcttgagcgtacagagatcgtcagggatttgaggatggacgtgtttgatgtgcttgtcggcatcaatctgctgagagagggactggatattccggagatcacactcgtcgcgatcttggatgcagataaagaaggctttttaagatcagagacttctctggtgcagacagtgggccgtgcggcgcgaaacagtgaaggacatgttatcatgtacgccgacaatatgacggattccatggaagccgccatcagtgagacaaaccgcagacgggcgatccaggatcagtacaataaagagcacggtattacaccgcagacgattcagaaggatatacgtgatctgatcaagatttccgatgaggaagaagcagagcagtccaatgaaaaagatatcgagtctatgaacaagaaagaactgaaggaaaatattgaacggctcaccaagaagatgaacagggcggcggcagagctgaactttgaggaggccgcagcgctgcgggatgagctgaaagaatataaaattgcttacagagattatgataagtaaggagatactatgaagaaggatgttatccggatcagaggagcgaaagaacataatttaaaaaatgtggatttacaaatacccaggaacgagttcgttgttctcacaggactgagcggttccgggaaatcctccctggcattcgatacaatttatgcggaagggcagaggagatatatggagtctctgtcctcctatgcaagacagtttctcggacagatggaaaagccggatgtagacagtattgaaggtctgtcgcccgctatttccatcgaccagaaatctaccaaccgaaatcccaggtccacagtgggcacagtgacggaaatttatgattatttccgtctgctgtacgccaggatcgggattccgcactgccctaagtgtgggaaaccgatcagcagacagaccgtagaccagatggcagaccggatcatggaacttaaagagggaacaaagtttcagcttctggcgccgatcgtccgcggaaggaagggaaggcacgaaaagattttctcaaatgccaagagaagcgggtatgtccgtgtcagggttgatggaaacatttatgatctggaggaagagatcacactggacaaaaataaaaagcacagcattgagatcgttgtggaccggctggcagtgcgcccggggattgaaaagagactgacggattctattgagacaacgctggacctggcggacggattaatgactgtggatattattggaggagaaccgatgaatttcagccagagtttttcctgtcctgactgtgatatcagcattgacgagattgagccgagaagcttttcttttaacaatccgttcggagcctgcccggtatgtcacggtctcggatataagatggaatttgatgtggatcttatgattcctgacccaaaactgagcattgcggaaggtgcgattcaggtgatgggctggcagtcctgtacagacaagaaaagttatacccgggcgatcctcgatgctcttgcaaaagaatataaatttgacctaaacacaccttttaaagactatccgaaaaagatcagagacgtgattctttacggaacaaatggaaaagaagtgaaggttcattatacaggccagaggggacagggtgtttatgatgtatcctttgaaggtctgatcaggaatgtaggccgaagataccgggaatcctctgaatctatgaaggcagagtacgaaaattacatgacggtcaccccatgtgaggagtgtcacggacagagactgaaggcagagtcactggctgtgactgtggcaggaaaaaatattgcggaaatgtgtgacatgtctgtgggagaaatttctgtctttttggacgagatggaactgacagaccggcagcagtttattggaagccagattttaaaggaaattaaggccagagtagggttcctcaacaatgtggggcttgaatacctgacactttccagggcaaccggaacactttccgggggagaagcccagagaatacgccttgcaacccagatcggatcgggtcttgtgggtgtggcatatattttggacgaaccaagcatcggtctgcatcagagagacaatgacaaactcatcaataccctgaaaaatttaaaagatctgggaaataccctgctggtcgtggaacacgatgaggatacgatgctggcagcggatcatattgtggacgttggacccggagccggagagtacggcggtgagattgtagcccagggaaccgcccagcagatcatgaagaataaaaaatccatcaccggtgcatatcttagcggaaggattaaaataccggttccggaggagcgcagagagccttccggctggatgaaggtaattggtgccagagagaataacctcaaaaatatcgatgtggatatccctctgggaatctttacctgtgtgaccggtgtatccggttccgggaagagttctctgattaatcagattgtttataagagactggcgaaagagctgaaccgtgcaaaaatcaaggcgggaaaacacacagacatcgaaggctttgaccagctggataagatcatcgatattgaccagtctccgatcggacggacaccgagatcaaatcctgcgacttacacgggtgtatttgatcagatcagagatttgtttgccatgacaaaggacgcaagaagccgcggatacaataaaggtaggttcagctttaataaaaagggcggaagatgtgaggcatgcgccggggacgggatcattaagatcgagatgcatttccttccggatgtgtatgttccctgtgaagtgtgtcagggaaagaggtacaacagagaaacactggaagttctctacaaaggaaagagcatttatgatgtcctgaatatgacggttgaggaagcctgtgaattcttttcaaatattccgagcatcagccggaagatggagacgctgagagatgtgggtctttcctatatccgtctggggcagccttccacccagctttccgggggagaagcccagagaatcaaactggctacggaactgagcaaacggagtacaggaaagacaatctatattctggatgaacctactacaggacttcattttgcagatgtccataagctggtggatattttgagcaagctgacggaaggcggcaataccgtcattgtcatcgagcacaatctggaagtcataaagactgcggattatattatcgacatagggccggaaggcggaaataagggaggaactgttgtagcccagggtactcctgaggagatatgtaaagcagaacagtcttataccggaaaatacctgaaaaaatatctggataaataataaactgccggacatgcggtgagcatgccggcagtttttgtacgtcggtttcgatgcagctaatcttccatttgcttaccgaggaaagatgcacctatttttgcgatggtcaggtcctgttcattcattttgttttcattggaaagaatacagaccagtccgatagcatctccttcggcaataatcgtagccacagcctgatttgtaaattcatcaggaaaatcggagatgatcggaacaaaattctgatctcccttggctgcgctgaactgtccgcggtcaatgatgatctgttctgcctgctcatgcaggagttttccggacagtttttttccgttcggacctgcggcggcgatgacggaatcctgatcacagatacagattgtatgaggaagggttgcagctatggactcagcgtactgttttgctatctgccccatttccccgatcggagaatatttttttagaataatgcttccgtcgtgttccgtaaatatctccaaaggatcactttctctgatatgcattgtcttgcggatttctttcggaattacgatccttcccaagtcatcaatacgtcgtactattcctgttgctctcatgtgtttacgtctcctctcacaaacatatattttcccatgtggatattgtttgcatcgggagaaaaaatataccaaaactctttttactatgatataattaaaaactagagcgagatgaaaagcataaattcaatgataaaagataaaggagtaagagatgaattttaaaattagattaactgcaaaagatctgtatcagttctctatgacccatgcatataatggacagtcagggatttttacagttatctgcgttttagtcgggattatgatggtattccgcggcacagcagccggaggcggaatgtattatgcaatgcttggagtattaatgatcgcacttttcacgatcgtcacaccgcttattttgtatatgaaggcaaagaaacaggcagcagggaatccaatgtatcaaaacgaaacggaatatgatcttcaggaagacggaattcatgtggtaatgggagatcaaacgggcatcattccctggaatcagatcttcaagatcagacacagcagaggaatgtatattttatatacaggaaaacaaagtgcatttatctatcctgatgcagcactcggagaacagaaagatgagatcatgaattatatttatcagcatgtaccggccagtacaaagcttccaaagtatgcaaagaggtcttagtatgacagaaagcttcagttatgaggatacatttcgtacaggcttcctgctgggagaaaaggccggacctggagatgtgtactgtctctgcggagatttaggagtcggcaagacagtctttacccagggatttgcaaagggtcttggagtagaggaacctgtgcagagtcctacttttacgatcgtgcaggagtatgaagaaggacgtctgcctttttaccatttcgatgtctaccgcattggggatgtggaggagatggacgaaattggatatgaagattacatttacgggcagggagtttctctgattgagtgggccaacttgattgaggagatcctgcctgaacattatacgaagattacgatttccaaaaacctggaacggggatttgattaccgggaaattaagattgaggagatatagatgaagattttagcgttggatagttcagggcttgtggcatcggctgcttatcttgtggacggtgtaatggttgcagagtatacggtcaatgataaacttacccattcacagacgctgcttcccatgctggatgtgatgagaaaacaggtgggatttgagctgacggaactggatgctgttgcagcagccatggggccgggctcttttaccgggcttcggatcggggcagccacagtaaaagggctcggcctggctctggacaagccggttattccggtcccgtccgtggacggcctggcttttcagctgtacggagcgcagggaatcatctgtcccatcatggatgcaagaaggaatcaggtttataccggattttaccgttttgagcgcggacagtttaaagtaataaaagaacaatgtgcccagagcatgcaggatacgctggatcagctggatcagctggcggattttgaggatacggtaattttcctgggggatggggtgcctgtccatagggaaacgatctcagaacagttgggtgaaaaggctttttttgctcctgaatttgcggggcggcagagagccggtgcagtgggggcactggccggtatctattaccaacagggaaagtttgtcacggcagatgattttgagcctgaatatttacgaaagtcccaggctgaaagggaaagagaagaacggctgaaacatgaagaaaccaatatttgaggtaagagaaaaggatcttgcgatgattgcagagctggaaaagcagtgtttttcagatccgtggtctctccgcacgatcgaggacgccttcagacaaaaggattattttatatatgtatggcgtgacatgaaacgcgtcagcggttatgtcataggccgcctggcggcagatgagggagaactgctcagagttggtgttctgccttttatacggaatttcggcattggagcacggctggtccgcgttctgcaggaggagcttgcaaaaagatttgtctccgctgtatatctggaagtgagagaatccaacaagccggcgatccgcatgtataaaaagcagggatttatcgttcagggccggcgacccaaatattaccggaatccgatggaagacgctgttttaatgcgctgggacgttccggcccagtcattaccagtagtatcggaagaaaaaccttcttataatgagacccataaggaggagaatgagatgaagtgcaacttatgtggtcgaacaatcaaagagaaggaagatttttttaaaggtgagaaggagtggggatatttttcaggcaaagatctggaatgccatgaattttatctttgcgaacattgttatgatgaactggtaaaaaaatttaaaataccggtttctgtgaaagaaaagaaagaagtcttgacttagaaaaaggatgtaaaatgttagatgtatgtttattaggtaccgggggcatgatgcctcttccatatcggaaactgacggcgtgcatgaccaggttcaatggccatgacgtgctgattgactgcggcgaaggaacacaggtggcgatcaaagaacgggggtggagtgtgaagcctctggatgccatctgttttacgcattttcacgcagaccatatcagcggacttccgggtcttttgctgacacttggaaatgccgagcggacggaaccgttattgatcattgggccgaaaggtgtggagcgggtcgtacagtccttaagggtcattgctccggatctcccgtttgagatcgaatttttggaattatccggcaaacaacaggtgattcctatggacggatatcagatcgaggcgttccgggtacagcataacattatgtgctatggatataatatgatcataccgagagccggaaaattcgatccggaaaaggcaaggctgaacgacatcccgatgaagtactggagccgtcttcagaaaggcgagacgatagaagccgacggacgtatcttaaccagtgatatgatcctcggtgaatcaagaaaagggattaaactgacttattgtacggacacaagacctgtccctttcatagcagaaaatgcccgtggtgcagatctgttcatctgtgagggcatgtatggggaagaaggcaaagagaaaaaggcaaaagagtataaacatatgacattttatgaagctgcaaggcttgcgaaacaggcagatgtgggtcagctctggctgacccattacagcccgtctttggtaagaccagaggaatttatgggaaaggtcagagaaatctttccgagatccaaggccggaaaggacggaaaaacggttactttggatttttgtgaggaatagggagcggacaatggataaaaatattaaaatactggcaattgaatcttcctgcgatgagactgccgccgcagtagtggaaaatgggagaagtgtcaaatccaatattatttcatcacagatagaactacataagctgtacggcggagtcgtaccggagatcgcatcgagaaaacatatcgaaaagatcaactatgtgatcagagaggcgctgaatgaggcgggtgagactttggattctattgatgcggtagcagttacctatggaccaggactcgttggagctttgctcgtgggtgtagcggaggcaaaggcaatcgcttttgctaaaaacaagcccctggtaggggtgcatcatattgaagggcatatttgtgccaattatatagaacaccacgagctggaacctccgtttttatgtcttgttgtatccggcggacatacacatctggtggatgtaaaagattacggtgtctatgaaatcatcgggcgtactagggacgatgctgcgggagaggcctttgacaaggtggccaggtccatcggtctcggctatcctggaggtccaaagatcgaagctctggcaagagaaggcaataaagaagcgattaagtttccaagggcaaaagtggacgatgcgccgaatgatttcagtttcagcggactgaagtcctctgttctgaattatctgaataagtgtgagatgaagggggaagaagtaaaccgggcagatgtggcggcttcttttcaggaagctgttgtggatgtgctcagtactcacggcgttgaagcggcaaagaatctcggctaccggaaacttgcgattgccgggggagtggcttccaacggagctttcagggagaaaattcagaccagatgccgggaagcaggaattgcattttatcatccatcacccatattatgtacagataacgcggcaatgatcggagctgcagggtattatgaatatatgaacggagccagaagcggctgggatctgaatgcggttccggggttgaagatcggccagagataaacaattaggagatgccatgaaggagaaaatcgtagccatagtacttggcgcgggagaagggaaacgcatggggagcgggattcccaaacagtatatgatcattaagtcgagacctctgatctactacgccctgaaagcttttgaacacagtccggtggatgaagtcatcttagtaaccggagaggatgagattgactactgtcagaaatatattgtagacaaatatcagtttgaaaaggtgagcagaatcgtagccggcggccgggagcggtacgagtctgtctatctcgggctgagaagcattggagaggcagactatgtcttgattcacgacggagcgaggccgatgctgaatgccgatattatacggaaatgtattatcaatgtgcgcaggcataaagcttgtgtggtcggtatgccttcaaaagatacaatcaaggttgtagacaatgacacttatgctgtttcgacacctccaagaagaaagctctggcaggtccagactcctcagtgttttgattttaatctgatctatgatgcctatcagaagttgatggacagcggagatactacggcaaccgatgacggtatggtacttgaaaattatggagatcagagagttaaagtgaagcttattgaaggaagttatgacaatattaaggtgacaactcccgaggatgtgagaatcgcaggaagccttgtgaaggccagaaaactgttccggttcctgcacaatgtccatgataagattatttatctgcagatgaagatactgcagaagcggttttttacaaaaaagaaaaaatagtttacagattttattctaagtattttaaaaataatcagatacatttcatgtgcagtgacagacgaaaatctgcctgattgcggcatgagtccgtcagataccaaaaaaataaacttttttcaaaaaacttgttgacaagtgtaggagcgtttggtattatatacaagcgtcaccgagagaggcgctcaaaaaacaaacaaaacaagtacctggagaggtatcgaagtggtcataacgaggcggtcttgaaaaccgtttgtccgcaagggcgcgtgggttcgaatcccaccctctccgttactttgaagatcagcattagctgacagcaaagtacttagggacgcttggagaagtacccaagtggctgaaggggctcgcctggaaagtgagtaggtcgttaatagcggcgcgagggttcaaatccctccttctccgttggaactttgacaagaggttctgaaagataagtttgagtgcagtgtgcacttcggaagtttcacttcctcggtcgcggcagagccgcttatataaaaaggtaaatcgtatacgcttagaagaatgaattcttcacgcgatacacttcattttttatgcacacaatactacaaacgcgaacattgacaactaaacaataagacaaccttgaaaattctaagagattttcagtatcttttgaaaaagatacacgagcgttctttatataaaggacacagtaaaacaaggataaaaaagctagcgctttttagatctaagattgaacatgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcattacggatgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttctaaggaagaagaagtaaaggttgtcttattgttcagttgtcaacgagaactgcgcaggaagaaaaggaacagatcgttgaacggaaacgttcataagagatggtcgttttctggatgcatagggcgagagctcggaacgcgagcaggcaaagcctgtgagagtggcagtttaggaaacaacaaaatacttccggtggcgatgcgttttggggaaacacccgtacccatcccgaacacgatggttaagaccaatacggccgatgatacttggttggagacgacctgggaaagtaggtggctgccggatttttatatgggggattagctcagttgggagagcgcctgccttgcaagcaggaggtcgcgagttcgaatctcgcattctccaggcagacaatgaagattgtctacaattaaatgatgggccggaaggaacggccatatccaaatgggcttgtagctcaggtggttagagcgcacgcctgataagcgtgaggtcggtggttcgagtccactcaagcccagcagcgtaacagagattgttggtggttcatgaaagcatctcagagacttcgtctcttcgatcgcggcagagccgctcatacaagcaaaaagtaattctgcttaggaatgtaaacattccacacagaattccgttttccttgtgttttcaatcctgcatacgcggatgtaccttgaaaacttcatacagaacacaaaaagttattttttataagaaatgacaagacatcaaacaaaacgaattacccgttgtcatcacgctagatgacaatgaggatgatagaacaactatcgtccgttctatggttaaagtagaaagagcgtagggtggatgccttggcactaagagccgatgaaagacgtgataagctgcgataagctgcggggaggagcaaatatcctttgatccgcagatttctgaatggggaaacccggcagagtaaacctctgtcagcgtatggtgaattcatagccatgcgtggggaacccggggaactgaaacatctaagtacccggaggaagagaaagaaacctcgatttccaaagtagcggcgagcgaaatggaaagagcccaaaccaggatgcgtgcatcctggggttcggactgcagcgtgggattatgtaggacaggagagcggcctgggaaggccggccagagagggtgaaagccccgtatccgaagtctaaagtaccctagcaggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctatgtttacaagctgtggaacccctttagatggggaactgcgtactttttgtagaacggtccggcgagttgcccgtactggcaaggttaaggacttaaggtccggagccgaagtgaaagcaagcgttaagagcgcgaaaatagtcagtgagggcagacccgaaaccgggtgacctatccatgtccaggttgaagcttccgtaagaggaagtggaggaccgaacccacatccgttgaaaagggtggggatgaggtgtggatagcggagaaattccaatcgaacccggagatagctggttctcctcgaaatagctttagggctagcctcatcaaagtctgctggaggtagagcactgaattgtctagggggcgtcaaagcttaccaaaacatatcaaactccgaatgccagccagatgattgatgggagtcagactgtacgagataagttggacagtcgaaagggaaacagcccagaccaccagctaaggtcccaaagtacgtgttaagtggaaaaggatgtgggatttcaaagacaactaggacgttggcttagaagcagccatacattgaaagagtgcgtaatagctcactagtcgagagatcctgcgccgaaaatgtccggggctaaaacacgacaccgaagctgtggaatgtaggaatacattggtagaggagcattgtaagcgggatgaagccataccgtaaggagtggtggactgcttagaagagagaatgccggaatgagtagcgagaggaaggtgagaatccttccggccgaatatctaaggtttccagagtaaagctgatctgctctgggtaagtcgggacctaaggcgagggcgagagccgtagtcgatggataactggttgaaattccagtaccacataaaaacagaactgtggggacacagaagggaaatgggagccaggaatggaaacactggtgcaagcgaagtagccgtatgggaggcaaatccctcatgcaaggcaaaggcgttacgcggaccgaacaaaagtagggaagcccaggcccccagctgtcaagaaaagccgctattgttttttatgtgcccgtaccgtaaaccgacacaggtggatgaggagagaatcctaaggccgacgggagaagtgttgttaaggaactcggcaaaatgactccgtaacttcgggagaaggagtgccatagtgatatggccgcagagaattggcccaagcaactgtttagcaaaaacacaggtctatgcaaaaccgcaaggtgaagtatatgggctgacgcctgcccggtgctggaaggttaaggggagggcttagcgcattagcgcgaaggtctgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacctgcgccaggacggaaagaccccatggagctttactccagcttgatactgggattcggtactgcatgtacaggataggtgggagactgagaattaaggacgccagtccttaaggagtcactgttgggataccacccttgcagtattggatttctaaccaacagccatgatctggttgggggacaatgtcaggtggggagtttgactggggcggtcgcctccgaaagggtatcggaggcgctcaaaggtcttctcagaatggacggaaaccattcgcagagtgcaaaggcagaagaaggcttgactgtgacaccgacgggtggagcaggtacgaaagtaggacttagtgatccggtggtataacgtgggattgccatcgctcaacggataaaagctaccctggggataacaggcttatcactcccaagagttcacatcgacggagtggtttggcacctcgatgtcggctcatcgcatcctggagctgtagcaggttccaagggttgggctgttcgcccattaaagcggtacgcgagctgggttcagaacgtcgtgagacagttcggtccctatccggcgcaggcggaggaaatttgataggagctgtccttagtacgagaggaccgggatggacggaccactggtggatctgttgtattaccaaatgcatagcagagtagccaagtctggaagggataaacgctgaaggcatctaagcgtgaagcccccctaaagataagatttcccatagagtaatctagtaagaccccttgaagacgacgaggtagatagggcagaggtggaagtgcggcaacgtatggagctgactgttactaatcggtcgaggctttaaccaaggaaaggtaaggaagaaagtttgatggaacgttctgtatgtagttttgaaggtatacccacagggcatcccgtattacatgtcctacggacgatatgctttgcattacaaggtatatttcaaaagaaaaaggaaagaataaaaagaatgatcctcgatagctcagttggtagagcgcacggctgttaaccgtgttgtcgctggttcgagcccagctcggggagtttagtaagaccgtgaagcggtcaaagaaacaaggctccatggtcaagtggttaagacaccgccctttcacggcggtaacacgggttcaaatcccgttggagtcattcagcttcatatttcgccgttgtggctcaattggcagagcagctgatttgtaatcagcaggttaccggttcaagtccggtcaacggcttcatacacttggacgttaagtggtgagaagataaggacctttagctcagttggttagagcaatcggctcataaccgatcggtccggggttcgagtccccgagggtccatttgtatacagttatttttggcccggtggctcagctggttagagcgccgccctgtcacggcggaggtcgtgggttcgaaccccatccgggtcgtctcttttatttaaaaagagtatttttatatttgggatcatagctcagctgggagagcatctgccttacaagcagagggtcataggttcgagccctattggtcccattttgagagaatttctctcagaatgccgttgtggcggaactggcagacgcacaggacttaaaatcctgcgggacttatactcccgtaccggttcgattccggtcaacggcattgagcacttattaaaagtgctgcttaatttcatatgtgggcgtagctcagctggatagagcgtctggctacggaccagaaggtcgggagttcgaatcttctcgcccacgtaaaacccttataaatcattgatttataagggttttttgtgcagtattatttattataaaagttcggaaaaaatgacggaaaaatacctattttgtatgatgagaggtttactttacagaaatgttgtggtataattcataactgtgaatgaaatgtaacaatactgtaataaacataaaattaatataaaatatcgaagtaggaaggtaacatctttatgaagtcaatattaaaaaagacagcaatatgtctgctcgtcttttctatgatcattacatcaggattggcagctccgaaaaaagaagttcatgcagcacagggtacatacggcggacggatatggaaatcatgggtaaaactgagaaagtccaaatctaaaaaatcgaaggtgatccgtaaaatttcaaaaggagaacctgtgcaggttcattatacgagcgggaaatggagaaaggttacatacaaaggcaagacaggatttgtcctgaaaaaatatgtgtatattaacacaaatgctcctgaactgtcaggaagccaagaagaaaaaggacagacagtggcagcctttgcccagcgttttgtaggaaacccatatgtatggggaggaacaaatttaaacagcggtgccgactgctctggttttgtcggaggagtataccgttccttcggatataagcttccgagaacgtcttcggacctcagaaaagcgggcagaaaggtatcttataaaaacaagcagcctggagatctgatttgttacagcggccatgtagccatgtacataggcaacggtaagatcgtccatgccagcacaagaaaaacagggattaagatttctccgagagccaactacagaaaagtagtagccgtgaggagaatcgtaagagaatagatcaaacaaaatgtgcaagagaaatcctgcacattttttttcatgttctcataatgttttgatagaaggaggagcgtatgaaatcaatcttatttgtcaatggatgtatcagaggagaagaatccaggacattgctgatggccagacgatttcttgactgtctgagagggaaatatgagatcacagaggtgaacggcctttgtctgccgctggaccgtgaggcactaaaaaagagggaccgtctggcagctcaggggaattgggatgatccggtgtttgatgaggccaggacatttctggaggcggatatcgttgtgcttgcggctccgttctgggaaggaacatttccggctgccgtacacgcttatattgaacagatctgtgtcacaggtctgacgtttggatacagggaggacggaaccgcagaaggttacggaaaggcaaagagagccatattcttttccacaagaggaggaatttattctgagggtccgaataagaaggacgaccacgccggaaaattccttgattctgtctttcggatgcttggaatccagaggacagatgtggtgaccgcagaaggacttgatatcattggaaatgatgtgggactcatcatggatcaggcagtgagagaggcagaactgctggcagggactttttagggaaatgagaatgaatcttttccaaaacatggacgcaataacttgaaaaacatgataaaatacggttatataaatataatagaattcaaaagacaagaaaagaggcggcagttatgttaaacgtagaacatttatcataccggattaatgaaaacggtgcagatgtgcagatactggatgatgtgagtttctctgtagatgacggggaaatgcttgttgtcacaggacccaatggcggaggcaagtccaccatcgcaaagattttaatggggatagaaaaagcaagcggaggtaaaatctctctggacggagaggatatcacagactataccatagaccagagggcagaagcaggcataggatttgcattccagcagcctccaagatttaaagggctgacggcttccaggcttctctctctcgcggcaggggagaaactgaaggacgagcggtgctgtgaattgctgagcagtgttgggctctgcggaatggaatataaagacagggaagtggacgctactttgtcagggggcgagatgaagaggattgagatcgccacggtatttgcaaaagatcataaaatatgtatttttgatgaaccggaggcaggaattgatctttggagttttgccatgctgatcaaagaatttgaaaagattcacagagaaaacaaggcaagtctcattctgatttcccatcaggagaggattatccggatggcagaccgcatcatgatcatcagggacggccgggtagaagagatcgggacgaaagaagaggtctatcctcatctcatggcagaagaatctgaagagcagtgtgcttttatgcaggaataggaggataaggacatgaaattagaccaaataacggccggagtgctggaggctatcgacggccaggggtttgtacagaaaggtgcttataacctgcgtcagaacggacaggcagtatgtcacggcgacagtgagaatgtccgcatcgtaaagaagcaggacaagcccgggattgatatctttatcagcgggaagacaaaaggtgaggcggtgcatataccggtggttgtttctgcttccggcatcacagatgtggtttataatgacttttatatcgaggatggtgcagatgttcttattgtggcaggatgcggcattcacaatgacggggacgaggagagcaggcatgacggcatacatgcattccatgtgggcagccatgccaatgtacggtatgaggagcgccattacggggaaggaaaaggaaccggaggcagggttttaaatcctgtcacgaaaatatatgtggaggaagattctgtttttacgctggatacgactcagatcaaaggggttgattcgacgatacgggagacacatgtggagatgggggcagggtccaaactctatgtaatggaaaaacttatgacacatggaaaccagcaggcaatatcaaacatggatgtacagttaaacggggaggagagttctgcacagatcatatcccggtctgtcgccaaagacacatctacccaggtctttcatccgaaagccatcggaaatgcgctgtgccacgcacacgtgcagtgtgattctattatcatggatgatgcaaagatcagttctattcctgagatcaacgcaaaccatgtggatgcccagattatacacgaggcagccatcgggcgtatcaataatgatcagctcatcaaactgcgcacttttggaatgactggagaagaggcagaagcagtgattatagaggactttttaaaataatctttaaaacaacagggggagaataagggggagtatcaggatgctggaatcaagggaaaattatctggaagctatcttaatgttaaaacaggaattagggcaggtgcgctctatcgatatcgccagaaaattaaattacagcaagccaagcgtcagccgtgcggtcgggattttgaaaaaaggggggtatattctcgtggatgcaaaaggatatatatcccttacctccgaagggcttaaaaaggccgagtcgatctacgagagacacaggacgctgacttcgctttttgttcagattgcgggagtgccggaacatgtggccgaggaagatgcatgccggtgtgaacatgttctgagcgcccagacttttcagggaattaaaatgtttttaaatgaaaatggtatatgctgaagaaagggtgtataattaagaggaagataagacaaacagctgtgcaaggaggtagcagtatgggaagactcgaaggaaaagttgcaatcattaccggtgggaattccggcgtaggtgaacagacggcaaagcggtttgcaaaggaaggtgccaaagtcgttatcactgcccggagaaaggaaaagcttgaatctgtggctgctgatatagaggctgacggaggcacagtgctggcactgcagggcgatatttctgtcccgggagacggcaaaagaatcgtagaagcagccgcagagcatttcggtacgttggatattctggtgaataatgccggggtgctggacgaaggtctgcttcccatcgataaagtagcggacagcgagatcgacagaatcattgacatcaacacaaagggaacgatgtattttatccgtgcagcgctggaaatcatgctgaaaaataagagcggatctatcgtcaatgtggacagcattgcaggagtgaacgggggcggaggagctgcctacgtggcttccaaggcggcaggcctgggtattaccaaacacacggctatgcggtgtgcaaaagacggggttcggtgcaatgccatttgtccgggcatgatcaagactccgatgacagccggacagacgatggattctatggacccggatatgatgggggccatggctgtgcattctgatctaaggcttccagcatgctcagcagaagacgtggcaaactcaatcttatttttggccagtgatgaatctgctcctgttaccggacagtgtatcgtgctggattacggcgcaaacctctaagaattatatgggcctgggattttctcataggagaagatcccaggccctttttcattccataggaaagctgcaaagctgtcaagctcctcaaagcttgcctgctttgttcttcaaagcagaaagttcagaacaatagcagacgtgattgttctcattatttttcgcagagtacagtgccttgtcagtattggaccatagagtttgaaagtcttttccgtgctcaggataaaaaccgattcccacagagacacatacattgccgtcaaggttcaagtcctcctggcgggagttccagttctcaaaaaacagtgccagtaattcttcaagtctgtgtttatgtatagaaagacaggatatataagtaataaactcatcaccgcctatccttccgttgactgcttttggaaaagttttttgaagactcttggcgagggataccagtatcttgtctccaaaaggatgaccgtactggtcgttgtagatcttaaagttatcaatatccatggcaatcaggacgcctgaaggtctttgcttcatctgcttatcgatatgatcctccatgcagcggcggctcatcagtccggtcagatagtcaaattgggaataataaatggtctttttgtctatacggctgaaatccggtacagagcggtgaagatgaagtagctgccatccactgtccgaatactccgtaatcatgctgaaacgaagatggacagacggcagatttgttccgctgttcctcctgctgagtttaatttcgccggttatgagaaaaagattctcgcgcaggcaggaagattcataccattctttgtcaattaaaaaagtatgttcagcacggggagctccaaaggttttgagaaactcaagggaactttgacaaaattctccgaggcctgtgccaatctctgtcatacgaagatccagaaatttgtcaattccctctttcttattgtctatgagataactatgccagagaaagcggcaaaactcctctgcagatttcaagtttttcattcactccgaccttccatacattaccagccatgaaatgggcagaaatgtagacttttttcgtcgttaatgatattatttttatagagtgaatccgagacagcaaacgtaccggattcaaagattgttccgcatttatttttttacgggatgatccggatactataaaaaacaaacgggtaaaaaagtctactttttttaccacatttctgtgtttatgagcggccttcttctgcctgccggacccatttaaaaaatgtgttgtgagtggttccgagttgtttagcagattcccggccgcttattttttctgccttccagagtgtataaatgcggtcaaactcctttggtatttctttgggaggacgtccaaaactgacgcctctggctttggctacggcaatcccctcggcctgccgttttctgatctgttcccgttctgtctgtgcaacgtaagaaaggatctgcagcaccagatccgatataaagacacctgttaggtccagagcatttttaccgcgggtatccagcagcggaaggtcagtgacaacgatgtcggccttcttgtgtttggtaatagtacgccactcttcgataatctcttcatagttcctgcccaggcggtcaatggactttacaaaaagagtatctcccggccgcagctttcttagcagtttcttataaagaggacggttaaaatcctttcccgactgccggtcaataaaaatgttttgtttaggtattttcaggtccttcatcactgcgagctgccgttccacattctgatctttggacgataccctgacatatccataatccatttctctccctccttctgcaaaatgtgacagaatcattatcccatatggaacagcataaataaaaaggtaatatatgccgcagaaaaaataactggactctgttttctctccgtgtgttaaaatattattaaaactgtacagtatatgaaaaaggaggtgcaggaaaaatgatagaattaccggaagctctggcaagggcagatgaattgaagagtgaactcaaaggaaagagggcagagaaagtctggccgccgtcttctccgcacaagttctgctggtttaacggggaagcgtcatcttatgacgatatgctgagtggaaggaaggtggtcgatgcacaggggttcgggatctttgccgagattatttttgaaggagatctaagagtttgtttcaatgacggtgtgaatgtaaggatcttcggggaaggggataacatacccggaaagtatcagcttaggatcgacttctcggacggaactgttcttgtttttacagtagcgatgtatgggagcattgcatgtgcagacggaagttatgacaatgaatattatattgtaagtaaaaacagcatatcgcccatctcaccggagtttgaccatacctattttttcgggcttctggattcagccaaaccgaacttgagcgcaaaggcttttcttgctacaaaacaacggataccggggctgggaaacggtgtccttcaggatatcctgtttgaagcgggaattcatccaaagaaaaagatcggcagttttacagaacatgaaaaggaactcctttttgtgagtataaaagaagtattgtctgaaatggtgcgtctcagaggaagagatacagagaaggatctctggggtaatcccgggggctataagacgaaactctccaagaacacatataaagacggatgtccgaagtgcggcggagagattacaaaggctgcttatctgggaggtacagtatatttctgccctgaatgccagacataaaaatacctgagacaccttttgaatcaggagtctcagggaagtatgatatttgatgagaatagactgcagacacgtgtttagtccgtccgttcatctccttcaaagaacagggcaacggttcccgcacccgtatgggctccgatgacagttcccacgctgttgattactacagggccgttcagcttaggaaatgcagcttcgatcaggtccgcaacctgtctggcatcttcaaagcaggcggagttggaaatgaaacacttgccgctgtagtctgtgccgtcttttgcgtgctcttccattttcttaacgatttctttaatggcccgcttttttgtccgaatcttagcgcgggggatcaggtgtccctcagaatccatattcagcagaggacagatgccgagcatcgtgccgataaagcctgaggtcttggaaatccttcctccgcggatgtaggatgtgagatctgtggagaaaaaccagtggtggatcttcagtctgttggagacagtccattcatacacatcccggatgctgtccccgcggtctctcagatctgcggccatatctacgagcagtccatagccagaagatgcgcccagagaatccacaagaaggatttgacggtctgggtagatttctaatagttcctctctggcaatattggcagaattaaatgtaccggagattccggaagacaggctgatatgcaggatatcctgaccattctttaggaacggttcgaaaaattcgatatattcttctacatttacctgggaggtgcctgccagagcaccttcctgtattttcttatagaactcttcaaacgaaatactttttcccagatcatccatgtaatccttgccgtctaaattaacatgaaaacatacataaggaatattacgccgttcaaaataatttttttccatatctgctgtggaacagcaggtcaaaacaaatggttccatagtaatcccttttctctttctttaagtcatttatctgttgtttcctattataaaggaaattccagaaattatcaaaccggtgcctgtatacagcgaaaacttgtcttgttaataaaatatgaataattattacgaaaatattacaaaatgctttacaatattattacgacgtgctataattcataaatgtaaacgaaatgtaataattacgtaatatatagaaagaaattgagtgaggatacaatgaaagcaatcgcaaagagaaccgcaatgtttgcagttgcatgtttaatgataacaggtacggcggcagcatcacttccggaaaaagaagtgcaggcagcctcgggttataccggatatattaaaagtgcgactacaagtttaaaaaggagcaaatcaaaaaagtcaaagacattggccagaatcaaaaagggaaagaaagtcaccgtttattatacaagcggtagctggaggaagatttcctataagggaaagaaaggatttgtcccgaaaaaacgtgtaaagataagcacaaaagcaccgaagctcaagggaagcaaaaaaacaaaaggaaagacagtggcaagtttcgccaaaaggtttgtaggaaatccttaccgctggggcggaacaaatttaaatacaggagcagactgctccggctttacaaaagccgtctaccgttcttttggatataatatcccgagaacttcctcctctcagagaagagcggggaaaaaggtttcttataagaaggaacagccgggagatctgatctgctacagcggacatgtagccatctatatcggaggcggaaagatcgtacatgcaagttccagaaagaccggcatcaagatctcaccaaaagcgaattacaggaaagtcgtctctgtacggcggattgtaagataaataccgggagataaatatcaaaccggctaaagaaaaaaagcccatggaatcattaccccctatcctaaacttatgattccagggctttttttccatgttcagaaagggttaggcgtagtaaaatagagaaaacattcgctaattttaaaaattatactaattgtaccgatataagtgcaaaaactgattttatgagatatatacaaaaccggtgaaggatattatgattaatacataagcaagacgcttgcttaacttcatcggttttattcattgaaggaggcctacgagatgaataatttacaggaaaaagtaatacgtagaatgattgatacgtatggttttttcaccactgatgaactttctgaaatgacaggagtttctgtcagcagcatcaaacactctttaagcgatatcagccgtgagatagagaagtatgaagcaaaactattgacggcaccgcgaaaaggactgtgtttggtcgcaacggaagaacagagggaaatgatcctggatgacctcaatgaatatgccaacaaagatccggaatcattctactaccgaaagaactacatattagatacgttattttactatccggccaaatatacgattcagcttttctccgaagagctgtgtgtgagcaggaatatcattcagaaagatctgaagcatattgaagactatttaagtgagtttaacctgacacttacaaaagtaaggaatcaggggattcagatcaagggagatgaatttgatctaagacaggcaattgtggattctgaaaacaaaaagtattggaaacacgcctatattgaaaaactgcctgaaaacttagactaccgaatcagcaaacgggcctacaccttttttaccgaccattatccaaaagaaaacattatgaaggtgcaggacagcctccggaaggcagaggagtttttaaatcaaatctttgtggatatctctttttgccggctgacggaatatttattactgacaatcaaccgtatcggggaagggaaaatcctccaaaacgcgggaagccgaaagatgaccaagttagatacttctttcctcgatgcggctcggttgatattagatgaaattattcctcaagacggagacatgtcattagaataccagtttctggccgctaagctgatggttgcaaagacctgcggacacggaatacgccctaaggatgaaaaatatgagaacatcgcactggactatctttccattgttctggccgtgatgaagaaagagaatgtattaaagaatgaagttcttatcaatgacatcagttcatttttagaaaagatcacaatcaaacgtgattacaaattagtggaatgggacgacctgcacagagatgtgcagcatcagctgcaggatgtatatgcggcatgtatgacttatatttttgacattgaaggtaagctttctgtgatattgacccaggacgagattgcatggatcgcactgctgatccacaatgcgatgatggacagcagggagggacgtgaggcggtgcttcttactgccacagaccctcacaccgcaaggtaccagaagattaagattgagaatgcagttgaagggcttgagattatagacagcattcatatacgggactttcacccggaaacaatgaaaggacaattattgatttctacggttcccctaaaggagccgagggaaaatacaatcgaagtgacaaaacatatcgatcaggcggatatcaacaaaatcgccgtgagtctggatgagcttgagcacgacaaaaaaatgacggatgcgctggagacgacaaagaaatctttcagagaatctttgatcttaaccgacgttaatgtcatggaaaaacaggacgtgatacagctcgcaagcgaccttttgtatgaacagggtttcatagagaaaggattcagccaggaagtgtggaaacgggaattaaaaaggccgtccaccgtcgggaggggcatcgtaatgccgcatatttacaaagattatgtgaagcagagcggcgttgcggttgtaaggctgaaatatccgatttcatggacacccaacgaaaaggtacggctgatgttcctgattgcgattgattttgaaacttcggaggaaattctaaggtttttccagtatttctatgggatgatcggcaataaagaactgatcggacatcttctggatgcggagggaccaaaagagttttatgaaattttaatgagtgaagcagggtaacaatggccgaaaggcatctaatttaaaggaggaagcactatgttagtaaacatgaaagaaattttagagatcgcagagaaggagcagtatgcaattccatgtatcaatactccgaacgtggaaaccatccgtgcagtcattggtgcggcagaagaattaaacacaccgatcatcattgaccatgcacaggtacatgatccgctcattccgatcgagagaatcgggccggaaatgttaaaatatgcgaaggcagcatctgtaccggtttgtgtacatttagaccacggcagtgactatgatttcgtactgagagctttaaaagttggattcccatctatcatgtacgactgcagcgcacttccttacgaagaaaacttaaagagagtaaaagaattcgtaaagattgcacatccggcaggtatcacagtagaggctgagcttggagttatggcatctacagcggaagatactcatggagaagaggacgcagagagccgtgtcctgacaaacgaagacatcaaagaattcttcacagagccggaagaagcaaaagcattcgctgaagagacaggatgtgatgcactggctgtatgcttcggaacgatgcacggaatttacgcagagccgccggtactggacattgacagagtgaaagcacttcgcgcagcgattccggatacatgccgtgtcgtaatgcatggggcttcaggagtagaattctctcaggtacaggaagcgatcacagcaggatgctcaaaagtaaattactactcttacatggcaaaggcagcaacaaaattcgtagctgaccgtgttgctgagacagacggaaagattgcataccatgaattacaggaagaagctttcgaattcatgaaaggatatgcaaaagacgttatcaaagcgtttaaaaacgggaaataggattccgtaaagggagggaaacatttcatgaacagtgtggacttatccgaagtgctgctcgatgagatggtgatccttgatcgggaaccgtttaaggacaaagatgacatgttcaatgtaatgaccaggcagtttgaaacggcagggctcgtttcagacgccggggcattcaaaaaggctttggaatttcgggagactttggggccgacttacatgggcaatatgattgccatccctcacgggaaatgtaaagaggtcctgacacccggaatcgggttctgcagatgcagagagccgttcatttatgagtctggcggggagtcaggcgaagtaaagtacatctttgttctggcgatttctgaaaatcaagagaatgattaccatttaagagtgctggcaactttggcaggatttctggctcacgacgagtttttggcattattagaaaaggctgaaagttatgatgacttgatcaaagggatcaaagaactctagagaaggagggatgtatcatgaaagttgtagcagtgacatcgtgcgcgacagggattgcgcacacctacatggcggcagaggcgattcaaaagatctgtaaacagaaaggatacaagtgtaaggttgagaaacaaggtgcacttggaatcgaagacaagttgagggaccgtgacatcaaagaagctgacctgatcgtatttgccaatgatgtaggaattacaaaggcagaacgttttacaccataccaagacaagatttttcagacaaaaccacatgcagtgatcaaagacccgagtattatttttagtgaagtagaagagtagtagaagagagaattaaaatatgaagggatggatgaaaaatgagagacgtagtagatgatattaaagaagcgtttttaaccggtgtttcctatatgctgccgtttgtagtggcaggaggtattttagtagctttagggttcctgctgggaggatacgatatccccaatacagtagaaccgggaaggaattttgcatcaaccattttctggattggtaagattggtctgggaactttcatggtgccgatcttaggtgcgtatgtagcattctcaatcgccgacaaaccgggaatctgtgtcggaatgttcggtggctggctggcaactgacccttggggaatgggttattcctcaggatttatcggagcgctgattgcaggtattatcgcgggctatcttgtaaatgcgttaaagaagattccgcttcctaatgcagtgagatccctgcttccaaccttaattattccggttatcggatgtgcgggcatttgtttattgatgcactatgtgattggaggacctttaggagcattaacaggagcgttgacaacaatgttaaacaacctgggaacaggaaacctggtgctcttaggaattgttcagggatgtatgctggcatttgacatgggaggcccatgtaacaaagttgcttacgcatttgcactggcatgtatggaaacaggaaactatgcaccgatggcagcaaactttgtagcctgctgtgcaccaccacttgcaatggcatttgctatgttgattgcacctaagaaattcactaaggaagacagaacaggaatcgcaggatgttttgcaggagcattatgcatgatcacagagtttgcgatcccatatgctgcaaagaacttaaaatacattccgtgctttatggttggatccgcagtcggatctgtgatgtcttacttatggggaattacaatccgtgcacctcacggcggagtcttcgtagtatttgcaatgaacaaagtgcttccattctttatctgcttaattgtggcaggagctgtttcagctgcactgatcgtacttgtttctaaaacgaaaacggaagaagaattagcagcagagtaaataaaattaaaacaaaacaggagaaataaaatggcaaagttatttgatattatgggaaaattcccttttgcaccagacgacaagaaaccgatgttaatccgcaagcaggattactctacagcactgtatccgccggataatgcatttacatccgacaatacatttacaatgatcacaacggataccttcatgcttggtatttatgagttgggaccgggcggagtatttgcaccacttgacattcatcctggagatgagtcttactacatcttaaacggaccggttgttcagagaagcggaaacggacagtttgcttacttagagacaggagagggactgtttatgccggaaggtgcttggcactgctgccataacttctcagaccagaaggcaagaatcctttacttcatcactccaaaagcatggagcgagtccattcctccggcagttatcccgacagaggaagagacaaagttctacaaaggaccgaacaatgataaccttccggatatgagagacaagatccaggatatctcccgtcagggatgcaccgatgatatcggatgctggccggtagatccgacagaagcaagaaaaaccggagctgtttacgcagtgcgtgattttgagaaattaaacaacgtacacggaacaactcatccgatgcttatgagatttatcacaagcaacgattacggacacttcggcgagatgatccttccggcaggaggatacggaccgagatgttcagatcctgacacacatgcaggagacggagcactctactgtgttgacggaccggtaaccgtaaacctggttgacgctcaggaaagcttcgttatggaaccggaagatacgttcttccttcctgcaggaacgaaatatcagttagtgaactttgaagcaaaaccagtaaaagttgtatttgcagtaactgaattataatcccatccatgaaatcacgataagatatacataaatcatccaggcatagaaccgccgcagtgattggtgtataattaagaagaacacatggtgatttgcctagaaagattctttgcggcatgccgtgaagaatctttttggcaggaaaggggataaacgatgggacaatacaaaggcataatttttgacttggacgggacgcttcttgatacgatcggagatcttacagactccgtcaatgaggtgatggagaagtttggatttcctctccacgggccggaagactacaagaaaaaagtaggaaatgggtttaaaaagcttgtggagagaagccttcctgaggatgccagggatgagaagaccattgatgacgcggtgtctgcctttgtagaagcctatgaccggaggtatctggataagactgctccctatgaagggattttggaactgctggcgaagctttgtgagaaagggatcgccctcggagtcaattccaacaagagatcggactataccagtgcactgatcaaaaagtatttcgcgcatattccgtttgtggatgtgtacggagaaagagagggaatacccaagaagcctgatccggcaggggcgctgaagcttttggagcttatgggtcttgaaaaggaagaggtgctttatatcggggattccaatacggatatgctgacaggaaaaaacgcaggcctcgatacggtcggcgtttcctggggattcaggggaagagaagaactggaagcatatgggggaacttttgtggtagacaggccggaggaaatactcggtctgctggaaaggagcgagcaatgaaaatttctttaggatgtgacgaggcagcatttgacttgaaagaggcgattaaaaagcatctggaagatgcgggacatgaagtggtagacaacggcgtgggaccgggggaagtggaactttacccggatgtggcagtgcgtacctgtgaaaaagtaacaagcaacgaatgcgacaggggaattcttgtatgcggaacaggaatcggtatggcgatgacagccaacaaggtgccgggcatccgtgcggcagtctgccacgatccattctcaacagagcgctctatcctgagcaacgacggaaatgtgatgtgtatgggagcaagagtcatcgcaccacagctggcattatatttactggatatctggatgggacttaccttcaaagacggaccgtctaccgagaaagtagaacggattacatattacgaaaaacagttcagcaaataaagccaagtacataaacaaggagggttttctatgaattttaaatttggagtggatacgtttatctgggcagaagcatatggagaagaacatctctggatcatccctaaggcgaaagaactgggatttgaagtcattgactttgcgatctccaacccattcacatttcctgtagaaaaagtgaaggcagagttagagagagtaggcatcgactgtgtctgcactaccacgctgacacctgaaaccaatccgatctctccggatgctgagattcgtgcagaaggtgtaaaagccatgaaaaaatgtgtggatatctgcaacgaactgggtgcaccgattttaggcggtgtaaattatgcaggctggggatatctgacgaagaagccaaggaccgaggaagagtggaactggggcgtagagtgcatgagggaagttgccgagtacgcaaaggaaaccggagatgttaccatctgtgtggaatgtgtcaaccgttttgaaacacatttcctgaatattgcagaagatgcagttgcattctgtaaggatgttggaacaggaaatgtcaaggttcatctcgactgcttccacatgatcagggaagaaaagagctttgcaggggcagtaaagacctgcggcaaagaatatctcggatacattcatgtcaatgaaaatgacagaggtattcctggaacagggcttgtgccgtttaaagaatttttcaatgcattagtagagatcgggtatgacggacctttggtgatcgaatcttttgatccgagctttgaagaactgtccggcaactgtgcgatctggagaaaatttgccgataccggagaagaacttgcgattgaagggctgaaaaatctgaaagccatcgctgctgagatataggagggagaacagatgaatcgaattgtaaacaatcctgattatgctgttgaggatatgctgaaaggatttgtaaagacacataaagacattgtggcacctacggaagatcctcgtgtcctgaaatataaggatgcacctgtggaaggaaaggtaggaatcgtcaccgggggaggctccgggcataaacctgcattcatcggttatatcggtaagaatatgtgtgatgcagtagccgtgggagaaattttttcatcaccgacagcaaaggctttcttagatgccatgaaagaggctgattccggaaaaggtgttgcgtgcctttacggaaactatgcaggcgataacatgaacgtcaagatggctatgagaaaagcaaagaagcttggaattgaagtaaagactgttgtggcaaatgatgactgtgcgtctgcaccgaaagatgaactggaaaaacgccgcggtgttgcgggcgaagtgctcatgtggaaagtcgggggagcgaaggcttctatgggtgctgatctggacggaatcatcgcagcggcacagaaagcgatcaacaacacgagatccgtaggaatcggaactgcaccgtgtaccatccctgctgtggggcatccgaactttgagatcaaggacggaacgatggaagttggaatcggacaccacggggagccgggaatcaatgtacagccattaaagactgcaagtgagatcgcagacgagatgctggatattatccttccggacctgccgtttgcagagggagacgaagtggtagtgcttctgtcaggcctgggggcaactccggtgatggaacagtacatcgtctatgaccgtgtggaagaagttctcgcagaaaaaggaatcagtgttcacaaggcatatgtgggtaattactttacttcccttgagatgatgggtgtgacacttactgtgatgaagcttgacgatgaactgaaagaatgcatcgacatgccctgcgactctgtcggtttaaaacagctgtaagtccggcgttttccataaatttggagcatcactggacccaaaacaaattgaaaagtgtgatccttatgttacaataaataacagaaggaagcagtctgagtttaaagtgaggagaagaattatgtcaagttttaaaaatgcagaagcaggaatcatcgtagataagctgatcaagacgattcaggagcagagagattatctgagcgagattgacggaaagatcggcgatggtgaccacggcattaacatgaataaaggttttaccatgtgtgaggaaaagctcaagggacagacctataatatgagtgaaggactctgtactctcggtgagactttactggaggatatcggcggttctatgggacctctttatggtctgttgtttgatgaactctctgcggcaagcgaagataaagatgaaatcgatgctgaagtattcggagagatgatcagcggagccgtggagggaatccaggaaatcagtccggcaaaggtcggcgacaagactctgctggatactctgattccggcaaaggatgcttttatggaagcgaaagatgcaggcaaagactttgctgagtgtctggatgctatgaacgaagcggcaaaaaagggatgggaatctacgaaagatctggtagctaagatcggacgtgcaagccgccttggagaacgttccagaggggttctggatgcgggagctacaagctgttactttattgtgaccacgcttggaacagctgcaaaagagctgttgggttaatcagaatttaagaagaatgtgaactgttatagaaaatgcactggattttgccagtgcattttttgtgcagagagatagtttataatgtataatatagttgggttaaaataaataagattagaagcatttacggagacgattttaaaagaggaagcgaagggaaaagtgtttataaactcatcactgcttgtattaccagccaaagacggaagaaaggagatttctatgagacaaaaaattactgtttttttgattgctgtgttgctgcttgctaatacagggtgtcagaaaaaggaaacagcgaagtcagagactaccacagaaatcagtataagagatcaaattccaaagatttcaaagaaggaattgccagctatgaaaaagaaagcagcagaagagctgaaacataagtggagagatagtgtctatgatttagacagaatagtgtttgaacctgaatattataaaaaaatagggtatgattcatgggaagaatttataaaaaaaaatacggcagatggagatgtagaaaaatattctttagataatattgtgatcttagaaggatatgagaagggatccaccgtggcagatttcgctgtattcgctaaggaaaaagggaaatggaagtttttatatatttttaaataaggtaaaaaccgataaagcctatttgacttatgatttttctcgtgatatggtaattaaatgatagtaattatcaaaaaaggaggagcctatgagtttaacagacggagttatcctgattttagcggcgggaatcgttctttttgtgctgtggagatttatttcacgtatccgcaggggagaaacggggtgcggctgcggatgtgacggctgctctaaatcctgtgcatccagacaaaaagaagactcaaagtaagtgagtaaaaggctgtgagtattatcacagccttttgtaatttatatcttgacatgtaaaaatatgtatgatatattatcaacatagaaagcaccatacggtttctcttttctgaacctcattcagcaggatctatttcatctttcctttggcattcgccaatcataccccggtgatagacctttagaaccaatagtcagttaagaaaacaacgattccttatttatttttcatcaagaggagaggaatactgtacctggtgctttctttttgtggtataatatcaatgtctgagtaaaaatatattttaaatttttacttgttttcagcaatgaggaagtgggcttgtccactttgtttaaatatgatattataacattttgtaattattagaacttaggaggaaaaatcatgccagtaaaatacgtgtttgtcaccggcggtgttgtttcaggtcttggaaaaggaatcacggcagcatctctgggacgattactgaaagcgaggggttatcacgtaaccagccagaagtttgatccatacatcaatattgacccgggaactatgaatccaatccagcacggagaagtttttgtgacagatgacggagcggagacagatcttgatctgggacattatgagagattcatcgacgaagggctgaacaaaaaatcaaacgtgacgacaggaaaggtttactggaatattttacagaaggaacggcgcggtgactacggcgggaataccgtacaggtgatcccgcatgtgaccaacgagatcaagagccgtttttatagaaatgaagaggcgacggagcaggaggtagccatcatagagatcggcggtacggtgggagacattgagagtcagccgtttttagaggcactgaggcagtttcagcatgaagtgggacatgagaactgtattttgatccatgtgaccctgatcccttatttaaagagctcaggagaactgaaaacaaagccgacccaggccagcgtcaaagatcttcagggcatgggaattcagccggatattcttgtttgcagatcagattatcctctggatgacggcattaagagaaagattgcacagttctgcaacgtggaaaaagaacgtgtcatccaaaatctcgatgcagaagttttatacgaagtacctctgatgatggaaaatgaacatctggcacatgaggcctgtgcctgccttcatcttccgtgtccggaaccggatctttcagagtggcgcaagatgatcgacaactggaaacatccaaagcataaaatagaagtggctctcgtcggaaagtatgtatcactccacgatgcctatatcagcgtggtagaatctctggaacatgcgggtgttgccaattcggcagatgtcaccatccggtgggtggattccgagcgtgtcagctcttacaatgtggacgagatgctgggcggtgtccagggtatcattgttccgggaggatttggagacagaggtattgagggcatgatctgctccattcagtacgcaagggaacacaaaattccttatctgggactgtgccttggcatgcagcttaccatcgtggagtttgcgagaaacgtccttggctacgcagatgcccacagtaaagagtttaatgaaaatacggaacatccgatgattcatatcatggcagatcaggatggagtgaccaacatcgggggtacactgagactcggatcttatccttgtgtactggcagacggttccaaagccgaagaactttacggaacaaaagagatttcagagcgccaccgccaccgatacgaggtaaataacaagtacagggatgtacttcaggaaaacggtatgatgctttcagggtgctcaccggacgggcgtattgtagagatgatcgagattccgtctcatccgttctttttggcaacacaggcacatccggagtttaaatcaagaccaaacaaggcacatcctctgttcagaggatttattgaggcgtcactgaaaaacggaggaatgatctgagaaaggggtgcggcagtatgaagcatgaaatcatcggacagacagtaccagcagtagaagtggaacttgacaagggggaagcaatgttcacccagtcaggagctatggcatggatggacccctcgatcaaaggggagtctaagatggagggtggatttttaaaagggatcggaaggaagtttgccggagagtcactcttcatggtaacttactcttctgaaaaagatggagcaaagattgcttttgcatcaactgttcccgggacgatccttccgcttcagtttcagggaaccggaggaatgatctgtcagaaaaaggcttttctgtgcgctcagaggagcgtttctctggagactatttttaccaaaaagctgtcagcaggagccttaggaggagagggcttcatactgcagagactttccggagacggcatggcatttctggaagtcgacggagatgcggtgacgaaggaactggctccgggagagaccatactcgttgataccggaaatgtagtagcttttgaagacggtatcagttatgagattgagcggatcaaaggcgttaaaaatatctttttcgggggcgagggattatttctcacaaagctcaccggtcctggaaagattatattacagacacagaatttcaatgattttgcaggaaggatcgcatcgctgataccttccggcagctgatcagagcatacagaagacaaaaactgcccggttaatttacagggcagtttttttgtggtttaaaggagcagcagtgtggaaatggaaaagttttataatatattaaaattgtattgctaaatgaaaataaaagtgttatgatattttcataataaaaagaaatgaaaacacatgaaaatctcaaggagggcattatgcaggttaagggtgtaagattgtacggagtagatgacatcagattagaagaatttgaactgccggagatcaaagatgacgagatcttggtaaaagttgtaagtgacagtatctgtatgtcaacatggaagacagtaaaacagggagccggacacaaaagggtgccgaatgacgtagcagatcatccggttttggtaggacatgaatttgccggtgatattgtgaaagttggtaagaagtggcaggatcagtttaagccggggcagaaatttgctcagcagccggcgatcccgggacagatggagtctcccggatattcttatcagtactgcggcggtgctgcaacctactgtattttcccaaatgatatcattgaaaagggatgtgtatggacatttgaaggagacagctactttgatgcttccgtggcagagccgatgtgctgcgtcatcagcggttaccatacaaattaccacacggttccgggaagctatgagcacgtgatgggtacaaaagaaggcggaaatatcctgatccttggcggatgcggacctatggggctgggcgccgtaagctatgcgttggcttttgaaaataaaccgaaacgtgttgtagttacagacatcagcgatgaccgtgtagaacgggcaaaacaggtgatctctattgaagacgcaaaggcagcaggcgtagaacttcactatgtgaatactgcggctatggaagatcaggaaaaagaattgatggatattacagaagggcatggatatgatgacgtattcgtatatgttccgatcactggcgttgcagaacttggaaataagctgctcgcttacgacggatgcatgaacctgtttgcaggaccgacagattcaaagttctcagcgaacatgaatctgtatgactgccattactccagaaccaaaattttgggaagcaccgggggaaccattgaagatatgaaagaggcgatcaacaaggcggcatccaaggaaattaagccggcggttatgatcacacatatcggaggtatcgacgctgttgctgagacaaccaagaatcttccggacatcccgggaggaaagaaacttacttatatgcagtttgacatgccgctcacagcgattgatgatttcagaaaacttggagaaacagatcctctttatgctaagcttgccgatgcatgtgacaaacacaacggcctgtggaatgcagaagcagagaagatcttattcgatcatttcggggcataagaaaagatatgaggggtgccaatgtttgcagaggaaagaagagaacagattctattatatttgaaaaagcataagcgggctgaggtgaaagagctcatcgaagagtttcaggttaccggggcgaccctgcgggctgacctgcgggcgatggaagaagaggggtccatcgtccgtacccacggcggtgcattgctgaaagaagatgttttacagaaagaagacttcttatcactcagaagagggcacgaagaagaaaagaaagccattgccagaatcgccagagcttatgtgaaagagggagacgcggttatcttggacagcggaagcactacgctggagcttgcgctgctgttaaaagatgcgaaaaacatcaaagttatcaccaacgatcttcagattgcgttggaactgcaggaaaatccgtggattgaactctatattgtcgggggaaaagtgagaaataattttcgactgactcagggagccatcggtactgactttcttaagagtatagcagtgaataaagtatttttgtctccgaatgctctgtctgtctttgagggggcgactacgagcaatgaagagatgaaagagctcaagcgggctatgatgaaagcggcaggagaaatctatatgctctgcgacagctcaaagattgggcagagagctttttgtaagtttgccaggctgagcgaatttaaattaatgctcacggattccggaatttccaaattagataaaacagcgatcgaagaacagggacttgaagtaaagatctgcaaatgagggggaacatttgcacggaaatgaaggagatggatatatgaaaaacgcagtacaaaaatttgggaaatttttgagtgcaatggttatgccgaacatcggtgcattcattgcatggggactgattacagcactgtttattgaaaagggctggttcccgaacgcaaaacttgcaacaatggtcgatccgatgctgaagtacatccttccggttctgatcggttatcaaggcggtaagcttgtggccggagaacggggcggagtcatcgcagttatcgctattttgggtgttatctgcggaagcaacgaagttatgttcatgggagccatggctatgggtccgtttgcgggatgggtcattaaaaagtttgacaaggcagtggacggacatatcccggcagggtttgaaatgctggtcaacaacttttccgtcggtatcatcggaatgatattagcaatcatcggatattacctgatcgggcctgttatgacagcgatccttacagtgcttacagccggtgttgatttcctgatcgggcacagcctgctgccactggtatccgtatttgtggaaccggcaaaagtattgttcttaaacaatgcgattaatcatggtattttcactccgatcggaggagagcaggtacaggccgccggaaaatccattatgtatatgatcgaggcaaaccctggagcaggactcggagtgctgtccgcatactgggcattctctaaagacaaaaggacaaaggattccgcaccgggtgcgatcatcatccactttttcggaggaatccatgagatatatttcccttatgtactgatgaatcctgttgttatcatagcatctattgcaggttcagcatgtgcagtattttattactctttatttaacatcggacttaccggaccggcatcaccgggatccatcattgctttcctgacgatggcacctaagggatcaacgctggccgtattgcttggagtcgtgattgctgcggttgtttctttcctcgtggctgctccgatcatcaagatgtcgaatggaaagagtttggaagaagcctcagacagtgttcagaatatgaaggctgccagcaaaggcattgcaaagaaagcaggagagatcaaaaaaatcgtctttgcctgtgacgcaggcatgggctccagcgctatgggggcaacaaagttcagaaacaggattaagtctctcggacttggcattacagtgatcaattcctctgtagatacggttcctgcagatacggatgtagttgtatgccaggaagttttggctgaccgtgcggcaaagagtgcaccaaatgcacagctggtaacaattaagaactttcttcaggatgaggcgatcgacgatttgtatgacaaactggcgcagcttcagaaagaaagagatttaccggcaaaagatgctgtacaggaagcagagaagtcgccatcggaggatgaggcaaacccgatggtcatggtaaaagagggaatcaaactcggacaaaagagtgtttccaaagaagaagccattgaggcagcaggaaatttactctatgagctcgactatgtagaaaaagattatattgaggctatgcaggagagagagcggacagttagcacctaccttggaatgggagttgcgatccctcacggaaccggagatgccaaaaataaggttaagaaaacaggtattgttctggtacagtatcctgacggtgtggattttggagatgaaaaagcacagttagtattcggaatcgccggaattggaaatgaacatctggaactgctgggtaagatcactcaggtgatcgataaccaggataaccttgaaaaattaaagactgcgggcaatgttcaggatgtactggatatgctgaaataaaaagcaggagcttctgaaagacagtttataacccacaactgttttatcagaagctcctttttatttgactgcgctgacttttaatctccgaaatggctgaaagcatgtgccgtccggctgtatggctcttttcagtgtagcgtctataacctcgtttcggaatgcttcttttaattcttcgggtacatactgcataaaagggacaaggctgggctggtcgatccagccaatcatttcttcggcatcagtgaaaaaccggtctgcattttcttctgtgaccacgatgtttttaaactctgtgaggttcattaatccttcatattcaaattttgaaggcatataccaaggccattgaaaagattgaaaatactttttatatggttccgtttgaatcatgttacggatgatttcaaaaaaatccgagcagttcccttcgccggcgaaattccataggatctttcctccaggttttagagcggagtaggattggtttaagagacgagaatgatctttcacccaatgcagtgcggcgttggaataaatgacatcaaattgattcataaagttcatgtctgccatatccatattaagaaactgaagattcttttttttatgtttttttgcagtattgatcattccgattgaagcatcgattccaataacactgccttcgggcaccagcatggacaactgttccgtcaggaccccgtccccgcagcccagatctaaaatagattcattgccgttaagatgaaggtccgaaaaaagtttttgaccccattctttttgatgtctggaagcctgttcatattttttgccgttaaattcatagatacccatctgtattcatctccctgcttatttaatcgtttttttgagtataccatgatggagactggtacgcacaaataaattgcctgttgccaaatgtgagaacccgtggtatgatatttgtgaaatgaaaaaaatacgaaatttttaaaaaataataaaaatttttaaaaagccaggagggaattatgaaggctaaaggtgtgagaatgtatggggcaaaggatattcggctggaagagtttgaactgccggagatcaaagaagacgaggtgcttttgaaagtcatgagtgacagcatctgtatgtctacatggaaagaagtcaagctgggaagcggacatatccgcgtaccggatgacatagcagaacgtccggtcatcatcggccatgaattttccggtgtgatcgagcaggtcggagaaaagtgggcagacgagtataaagtgggagagagatttgtagtacttccggggattccggatcagatgggagcaccggggtattcctatgaacacttcggaggcgcagtgacatactgcatcgttcctaatgatgtgattgagaagggttgtctgctccactatgacggggatgctttctatgaagtatctgtgtcagagcctatgtactgtatcatcggcggatatatggcgaactatcatacgaagccggagacacacgaacattttatcggcgcaaaagcgggagggaacattgctatcctcggaggatgcggaccgatgggactgggcgcaatcagttatgcacttgccatggaaaacaaaccgaagacggttgttgtcacggaaatcaacgacgaccgaatcaaccgggccagagaagtgatctctgaggaagatgcaaaagcaagaggtgtggaattacattatgtaaacacagcaaagatggatgatgaggtcaaagaactgatggatctcaccggaggagagggataccatgacgtatttgtttacgctccggtaaaagcgattgcagagacaggaaacaagatccttgcattcgacggctgcatgaacctgttcgcaggcccttctgacagtgaattttccgcagacatgaacctgtatgactgccattacagaaatacgaagcttctgggatcttcagggggcattaaggcagaccttctggaagcgctcgatttgatcgcgaagaaagaggtcaatccggctgttatgatcactcatgtgggaggcattgacgcaatcgttgatacaactcttcatttacctgagataccggggggaaagaaacttacctatacacagtttgatatgcctctgacagcgattgaagacttcagaaaactgggtgagaccgatcctctgtttgcgaagcttgccgatgcatgcgacaaaaatcagggattgtggaacaaagaagcagaagaaattttactggatcatttcggagtataacttatgtttgcaagagagcggaaagaagaactgctggcttatatgagggtacataagagggctggcatccatgaactgtcggaagaattccatgtgaccggcgccaccataaggtccgatttaagtgaattggagaaagagggacacctgattcggacccacgggggcgcactgctaaaggaagaagaagtcacaaaggaggcatttcttgcctccaggtggaacttaaatcccgataaaaagaggatcattgcacagggtgccaaagagttcgtcagggaaggagatattatcctgatcgacagcggttctaccatgctggaatttgcaaaggttctgacagactttaatgacctgaaggtagtgaccaatgatctgaacatcgctcttgaactgcagaaaaagccttctattcaggtgatactgatcggaggaactgtgaggaaccagtttgaatgtacctttggttccctggggattgaatttcttgagaggatttccgtggataaactgttcttgtcaccaaacgctttgtcagtttccaaagggctgaccacgcccaatgaggagacagcggcgatgaagcgtgcgatgatgaggaccgcaacagaagcatatatgctgtgcgacagtacgaagattggacggaagaccttttgccggtttgcgaggaacagtgattttaaatatctgatcactgatgagggaatccagactgccgacaaaaaagaacttgagaagcagggaatcaaggtcagggtgtgtaagatgaaaggtcaggaataacctggaaattatcttaccaccggttataatttaaaaaattgtcaagcaaaaagggaagaaaatttattgagaatttttcttccttttttgcgttggatagaactgacaaaccgcgtatttatgcggtttataaggttattaaaaggaggaaaatgtaagaaaatcttgtcaaaaaatcttctgcaaaatttaccactggcaatagtggacgtatggaaatacaatcaatataatggaattatagataaacgtttatcagatatgaaccattaactgcagcaaaaaattataccaaaaagagaaggaaaaaaggaggattattatggcaagtagtttcaaagctaaagtccaaaaaatgggcggattcctttcaggaatggtaatgcctaacattggtgccctgattgcatggggtattatcacagcattatttattccgacaggatatttcccaaatgaaaagatgaacgaactcgtaggcccgacacttaagttcttgatcccgttgttatttggatacaccggaggtcatacagtatatggaagacgtggtgccgttgcaggtacacttgcaacaatcggtgttgtcattggttcagaagcaaccatgatgatcggtggtatggtcatgggacctctcggtgcatggatcatcaagcagtttgacaaattgttagaaggacgtgtaaaaccaggtctggaaatgttagtagacaacttctccatgggtatcattggagcactgatgatgatcgcgggattcgttgtaatcacaccgctttttgcaggtattacaagtgtcttaacagtcggtgttaactttgcgatcgatcacagcatccttccattcacaccaatcttcgttgtaccaggacaggtattgttcttaaacaacgcgatcaatcacggtatctttactccgcttgcgattgaacaggctgcagagacaggaaaatctattctgtatcttgtagaggcaaacagcggtaactgggcaggacttgtacttgcatttatgtgctttggaaaaggtatggcaaagaaatctgcacctggtgcagcgatcattcagatcatcggtggtatcggtgaagtatctttcccttatgctttgattaaacctgttactattcttggaccgatctgcggttccatcgcagcgttattctggttccagatcatgggcggtggtgccgttgcagcagtatcacctggatcaatcattgccttggcaattatgtcaccgaaaggaaagctgttcgtcaacctggccggatatgtcatagccgcgatcgtatcgttcgctatcgttgcattcttccttaaacgcgataagacgccggaagatgaggtcggagaagtaggcggactagatatgagccagtttgttgaaagtcacagcgctcctggagaagaaaagaaagctgttgtagcagacgatgcagagcttccaaaacgccaggttaaaaaggtagcatttgcatgtgatgcaggaatgggatccagtgccatgggagcttccatgctgaagacacagctgaataagatcggaatgtacatagatgtaaatcatgtatctattcatcagataccggcagacatcgatgttattgttacaaacgaaaacttatatgaagctgcgaagagtgcggctcctgcgggagtaccggtcattgcgatcgaaaacttcctggatgctgctgaacaggcagcaattgccaagaagattaaagacatggctgaataagtcagactgcggcgccataattgaagaattatggcgccttctaagtaaaggagctgcaaaattatgctgatgtctaatcgtgtaaaaggtatcatacagattgtcttaagcagccgtggtttcgtaaccatgaaagatattgccaacaagatgaatgtctcagagaggaccgtataccgggaaatccctgaggtgacagaagtgttaaggcagtatcagattacgttggaaacggtgagtaaaaaaggaatccgggctgtcggtctgcctgaacctattcagaaactccagacagaattaggggaacataaaaaactccaggtagtagaccctaaggaacgaatgtatttggttctcttagaactgcttcatcaggatgacttcatggagacagaagcattggcaatcgatatgggtacatccctcccgacaatcaggaatgatctgaaaaagattgagaaaattcttccggagtacaatattaaattaatctcaaaaaagggagatggaatctgcctgagcggtgagcaggtggcgagggatcatctgatggtcaatatcatcatgaaaaacacagatgtggatgtgatcgtacactggcttgcagggaatgtcaggcagtttcatccttttatgcagaagctggatgaatatggttatatggacctgtttcagacatgtgaaaaaatattaagagatatcagccataaactgatccaaaaaaattatcagatacttgaccagaactatgcagaattagtcatgctggtgtcactgctgatccgcagacacaagatcggaaacaggaaatacagtacagattttactgtggaacaagtggacaagaaccagaagaaggttgtcgccgcattgatccggatgctggaaaagaaatattccatttccctggacgaggcagaaaaagaatatcttctgtgggttatggatatcagtgtcggaaaaaggaacaatgaaaatgtgtttgtcaaaaattttgtgctcaagccaaagattgaagagtttgtagaactggtggaagggcgtatgggcattactctgagccaggatacaaagcttatggacggactgctgacgcatatcgataaagccctggtgcggacaaggagcggaatgagtatctcgaatccaattatccgcgacattgaaaaagattattcgcagctgttttccattataaaagatacggtcagaaaagtatttccggatgattattttccggatgatgagatagggtatctggtattatattttgcggtatcattggacaacattacaaagaagacattccgggtgctggtggtatgttccagcggtatgggatcttccaagatgctggccagccgtctggagagggagatacccgagatttatgtaagaaagattgtatctttggtagggctgggagaagaagacttaaacgattatgacttgatcctgtcaaccatcccgctgtatttaaaagacagggagtatctgaaagtttctccgctcctgaacgataatgagctggagattgtaaaagaaaaaattagaaggcataagcatcagactttaaggaagattgaggaacaggaaagaaaggcggcggagttagaaagcagcaacagtattgtatctttaaaacagttaaaacaattaactacgtgggcagtagacttattggctgaattccatgtgtatgaaattaataatctgaaggatgaaaaccacttattttcaaatttggaacacacgatctgggaagccggaatctttatcggtgaacaggagattaagaattatgtgatccggcatggaaatgaatgccgttttaccataccgacgacggaaatcagttactttgagtgttatttaaagaaaataaaaaaaccgcttcttttcgtctaccatttaaaagagaaacgaatggtcgatcctcaggagggtgatgcggtcagtaacattatatttttcttctatccaacggaaatggaagaagtacagcagatgtttctgcgatatattactgaattgatcatcgaagaccgggatgtcatgaagttaatagagaagggcgacgaagaagaaatcaggcaatgctttggacacaggttcagacattatataggagaatcaatttaggaggtttcattatggcagataagaagagtatttttaacgaagacaacatcagattgaacgcatcctttgctacgaaggaagaggctatccgggctgcgggacagatccttgcagacaatggttacgtaaaagaagaatatatagatgatatgctgaagagggaagaagtggtctctacctacatcggcaatcacattgcgattccgcacggcatcgtaaaatccgaagaaaggattatggcttcaggaatttcctttatccaggttcctgagggcgtagactatgaaggaaaaactgcaaatgtcatcattggaattgcaggtaagaacaatgagcatattgagattttaggagatatcgcagtggcatgctcagatcttgacaacgtagaaaaacttagaaatgcaaagaccaaagaagaaatactgaatgtatttaaagatgtggtccgctaaaacagacggagggaataaaatgaaagcagtacactttggggctggcaagatcggccgcgggttcatcgcagacttgctgcatgatacaggatatgaaatcgtattcgtggacgtaaatgagaaagtcaacgaggaactgaacaaataccataactactacttatacgtgatcgaggaggattacaggagaaaagaaatcgacaaggtttccgctctctctccgatcacagaagaagacaaagtcgtggaggcaatcgtggaagcagacgtagtcactacggcagtgctggcagacaatttccctaaaattgcaggtactctcgcaaaagggctgaaagccagattggaagcaggcaaagaaagagtcaatgtaattccttgtgagaacgcattgttcaacggagatctgctcttaaaggaacttgtcaaaactgaaattgcttctgaggatgacttcctaaaagcagcggcattcccgaatacggcagtagaccgtatggtattcggtaccgacaaagacggcagagacggaattgacatcggaaaagatcacgagctggcagtggaagtgaataagctggtagacccagagaaacttccgattgccggagcagaatataccgataatcttcagaagttcctggagagaaaactttatacaatcaactgcggacacgcatggtccggttatatcggaaaattgatgggatatgagatcatccaggattacttcgcggtgccggaaaacattgaaatgacaagagaagtcatgagagaagttgcggctctgatggttgcaaaacacggatttaccgagaaggaaatggaagactacattacgtttgcattaaaccgtttttgtactcctggtatcaaagacacgatcacacgtatctccagggcgccgatcagaaagcttgcaccgaatgaccgtctggtaggaccggctgtacaatgtgaggagaggggactcaaaaatacacttctcctgagaggtattgcagcgacattcctgttcgacgtcaaagaggatgagcagtctgttgagatgatgcagtatgtggctgacaacggcattgaagatgcagtgactcattttacaggtattgaagcgggaaccaggatgtttgatgagatcgtcaaagattacaacgaattaaaggaaggaaaataatatgaaattacagttagctttagatgaaatgaaccttgtagatgcactgcgtttcgctgacaaggttgcggagcatgtcgatattatcgaagtgggaactcctttcgttatggacgaaggaatgaggggtgtgcgtgaattccaccgtttcttcccggacaaagagatcctggccgatttaaagatcatggacggcggatatctggaagcaagctatgcctatgaggcaggtgctgcttatgctacaatcctgggtgtttctgataacctgaccattgaaggcgctttaaaagcggcaagagactatgacagaaaactcgttgtggatatgatctgtgtggaagatcttccgactagaattgcaaagatggaagaaatcggagttgacatcctggcagttcatacaggggctgaccagcaggcagcaggcagagagccgatccaggatcttcaggttatgacagaacatgcaaagaaggctcagatcgctgtggccggaggtattaacagtaagaccatcgataaatatgttgccttaaaaccggagattattattgtaggatctgcgatcggacatgcagaagatccggttgcggaagcaaaagcgatcaaagacgcgatgctttaaaccacaaattgagactggagggaaagattatgacagaatgtaaaaatatgatggcgattctcggagaattaaccgacaacgcaaaagaagtagataatgaacagatcgaggcagtggaaaaactgatcacagaggcaaaaagaatctttataagcggtgcgggacgttccggatttgctgccagaggattttctaatcgtctgatgcatcttgggtataccgtatactttgttggcgagccgaccacaccgtcgattcaggcaggagatctgctgatcgtcggttccggttccggaaataccgcgagccttgtgtctaatgccaaaaaggcaaagagccagggagcaaaggtagcgaccattacaatgttccctgagaacacgatcggatctatggcagatgcggtaatcactcttccgggagttacgaagaagtgtgacaatcatgagggtgcgggaactgttcaggctgccggttccggattcgagcagttaagctggattacatatgactgtatggttatggatctgatgaggattacaagtcagtcagatgacgatctgtttgcaagacatgcaaatatggagtaataacaaatatgatataaaaggggctctttccggagccccttttatataacacaataccagaagacatgacagtagggaggaatttcagactatgaaacaggttatgattgtaggagcaggacgccttggaaaaggattttttggagaaacattcgataatgccggatggaaaatcgcttttttagacaaggatccgagggtggtcgaggaactaaagaggacagggagttatcacgtggaagtccacagggtagattctattgagaaccggactgtctcagggtatgaggcttatgtctgtgatgaaaattattcctgcatggatgcgtttttgaatacggatgttattatgctgccgctttatccaaaagattttagggaagcaggacattatttatctaagtgtttcactgagttttataaaaagcagcctgagaaaaagctgaccgctatctgtgtgacaaacaaaaattatctgatcccggaaattatagaaagttttaaggaaaaactcccggatgatgtgaaagcgtggtttgatacgaatgtagcagtcagagattctattatccggagaggaacagatgcacagactcactatgccactgagatagtgacgatggcggttgcttcgcttctgattcagactcctgtatataatgatttcagcgatgttgaatggctggaactgaatgaccagatagaaactctgaaggatttaaaagtgtttgcaatcaatggacctcatgcgtcaactgctttctggggttatctgaaaggttataaaacgataccggatgccgaaaaagatgaggagattgccggcattatttatcaggcgcataaagagattctcgatatgatcatggaagaatacgatattacaaaagaggagctggatcatttggaaaatcttccgacgccgatgggagagattccggattccatctacagagtagcatttgatccgataagaaaactttccagaggagacaggcttaccggagctgcacagaggtgccttaaacatggtctcccttatgaagcgattgcaaaaggtatggcagccggctttggatatacggagccagaggatgaaaatgcggtaaagcttcaggaggaaatcaaagaattggggatcgaagagactgtgcataaatatacgaaacttgaaaaagacagccctattctgagaaaagtagtggaagaatatgaagctctgaaagacagaggactgataaaataagaagaataattttggcaaaaaagctgtgttccttttcattggggagacagctttctttgttatttatcctgatcctatgttacaataagtctgtattttatgtttaacaacagtggaaaaatacaggaaagggtgtgtatattgtggaaaataaatttgacgtcattattataggagcagggccttcggggattttctgtgcgtatgaactctcacaaaagaaagcggatttaaagatcttaatgatagagaagggaagaaggattgaagaccggtcctgtcccaaaaggaaaacaaaagtgtgtgtgggctgtaagccatgttccattacgaccggatttgcaggtgcaggagctttttctgacggaaagctttccctctctccggatgtgggcggaaatctgccgcagatccttggatacgaagaaacagagcagcttctgaaagaatcggaccagatctatttgaaatttggagcggacacaaaagtgtatggattgaatgaagaaaaagaaattgcaaggatcagaaaaaaggcaattaaagccaatctgaaattaatcgagtgtccgattcggcatcttggcacggaagagggatataagatataccaaaggcttcaggagcacctgcttggcgtgggggtcaggatggaatttaacaccatggttgataatattctgactgcaaaaggacgggtgaggggtgtggtcaccgataaaggagagacattctatgcagaggaagttgttgccgccgtgggcagggaaggatctgaatggctcagcaacctgtgccgggaacacgagattgcgactgaggtgggaaccgtagacgtaggcgtcagagtggaggttcgggatgaaatcatggaagaactgaacaagagcctgtacgaggcaaagctggtatattatacgccgacctttgacgataaagtccgcgtgttctgtaccaacccttcaggagaagtggccacagaatattatgaggacggacttgcagtagtaaacggccatgcatataaggcagaaaaatataagacaaagaatactaattttgcaattcttgtatcgaaaaattttacgaagccgtttaaagagcccatccagtatggaaaacatatcgcgcagctcagcaatatgctctgcgacggaaagatccttgtccagaggttcggagattttgtccggggacgcagaacgacagaggaacgccttctcagaaacaacatcacgccgacgttaagggatgcggtgccgggggatctgtcattggtatttccttacagaattatgaaagcgattgaagagatgatctatgcactggatcaggtgacgccggggatggccagtgatgaaacgctgctctatggagtggaagtgaaattttattccaataaagtcgtcacagaccaggcgtttgaaaccaacatcaaaggccttcgggcaatcggtgacggagcctcagtcacaaggggccttcagcaggcatcggctaacgggctgagcgcagccaggagtattttaactgcgaaaggagtatctatatgagatatatatgtaccgtcttatccgtatcggacattaagaaatccagaaagttttatgagaatttattcggattggagctttaccaggattatggcatcaatatatcctttacttgcggacttgcactgcagcaggactttgactggctggtgaacataccaaaagaggcagttctgaaaaaaacaaataacatcgagatctgctttgaagaagaggacttcgatggattcttgaaaaaactgaaaacttatccggatgctgagcatttgggagatgtgattgagcacagctggggacagcgtgtcatcaggttttatgatccggacgggcatctcatcgaagtgggagagtcaatgaaaatggtaattacccgttttctggattcgggacttactatggaagaagtttccagcaagatggatgcctcggcagaagatctgcaaaaacttttagataaggaagagtgatcctttgagttctatggataaaataggatcatatataagacgacagtatcgtttccggtgttgcggtaagagtgagcagtatctcccggaaatcgtatactttcgtcttttgttaaggtaaatttgtgacaatcagcgcatatttcaagatctccgtgaaatacagtgataaattctgtcgttcctttcagatgtgcttcggactcccagcggctgtatggttccaacttcagatagtatacggcgaatttcctgtcggcgtcatccggaaaaagcggataatttttaacccttcccgaatcttccagcagcggttctatgtctgctgtcttaatgatttcgtatggagtttttggacggacagtcaaggcatcaaagggtaccttcatgccatttgatattttccacaaggttgatatcgttgggttcccgtccccgcgctcaatttgggccagcatacttttactgacaccgcttaattttgaaagtgcctccatgctgagtttctgcttttcacggagacgtttaatgtttttggcaacaattaaattcattgtatccaaagaaagactcctttctattgacaatatattgtacaaattgtattattatatcatacgagtgcaatataataactgttttgtattattatattattttgaaacgggattgtaaatagaaaaggaggtttcatttgctgcatctatatgattttgtaatttattgttttataactgcttatactccgggggcaaataatctgctctctatgagcaatgccatacgccttggatttcgccgcagcgtacgttttaatcttgggatcttggccggctttacggcagttatgacaatttgtacggttttcagtacggcactttattcttctcttccaaaaattagatttgtcatgcagtttcttggggctgcctatatgctgttcctggcatggaaattgtggaagagttccaatgatatgacttcagacggaggaagtgaagccagctttctctcgggaatgatcttacagtttgctaatcctaaaatatacatttatgctataacagccatgtcactttatattcttcccgcctatcagtcgacaggcgctttagcagcatttacgattatgttatcattgatcggtgcgtcaggatcttttgtatgggcattgtttgggtcggctttttgcaattttttctcaaaacatttccgtgcggtcaatctggtgatggttcttctgctgatctactgtgcagtctcactatttatgtaaattcacaaaaaaacaaagattcattcagctgtttttgggcaaatgggcaaaaaataaaaaaagacttatgaagctttgaatgaccctgctatactaaatattagaaaataaatatatgacagaaatgaaaatggtagcgagattataagactctaatcgcagcgaaagttacagtcttatagtcccgctatttttttctgtatgaatcaatgaaaagtttggaggaatttatggaaaagaatcattttatggaacgggagagtattgggaaactcatgctgaaattttctgttccgtgtattatgtcactgctggtgtcatctctttataatattgtagaccagatctttatcgggcaggggatcggatatctgggaaatggagctaccaatgtggtgttcccggttacgatcattgcactcgcgatggcactgatggttggagatggatgtgcagcaaacttaagtatctgccaggggtgcaaagatcagaacagagccagaaagagcgtaggaaatgcgattgtgctgcttgtggcagcaggtgtggtttttactgttttactttttctgtttaaggatcagtttctgaaggcttttggcgcgacagagaataactttgcatatgccagggaatattttgtgtatatcatgattggaattccgttttttatgttttccaatggcatgaactctattatcagggcagacggcagccctcagtttgcaatgatatcattggtgcagttatcaatgtgatcctggatccgattatgatttttgtatttcattggggaatgatgggtgcagccctggctacgattaccggtcagattgtgtcagcgattctggcagtttattatctttgccatatgaaatctataaagatggaaacagaatgttttcgagtgaaccccataatttctaaaaaggtgctttctctggggatcagcagctttctgacacagatttcgatcgtagccattatggcggcaatgaacaatatgctcgtgatttacggagcacagtccaggtttgggtctgatattccgctgacagtggtgggaattgttatgaaagtattccagattgtgattgctttttctgtaggcatcgcagcaggctcccagccagtgatcgggtttaactacggagcaggactgaaccacagagtgaagaagatatttaagctgatgatggcggcggaagcctgcgtaggtgtgttttccatgatcatattcgaatgttttcctatggagatcatcaaactatttggaaatgagagtgtactttacaatgagtttgcggttcttgctttcagaacttatctttgtaccatagtattatgctgtatccaaaaatcagtcagtatttttctgcaggcattggggaagccaattctctcaatggggctctccctgctcagagactttattttaagtgtaccgctggttctatttcttccaaaattattggggataaaagggactctttattctgcgccggcggcagatatgatctcattcatcgctgtgattgccgtaacccggtatcttttcggacatttaaaaaaagatgaaaaggaggagagagaaacagcttttaacagaggagaagaaacaataaatctggtgtcagagtagattatgaaatgtctgaagcagggtccctttattccgggattcctgcttctttttcgtccgcggtatcagcatcatcatgtctggaggagtgtagataggattcatttgcttctttgcctgcagctatgagacgttccagcccctcttcagggcacagaaaagagccgatcggataaggtgtcttagtatatataccatggaaatccgtgccgccggtcataaataaatcatgttctttggccagagatctgacatggtcctttgtgcgctcatcatttctcggatgattcagttcgataccgtcgatgagtttttcttcaatgagcatctccatgagcatgggatttttatattctcccgggtgggccaggactacgacaccgccgcaggatcggatcaggccgactgcttcgtgtgttgtcagatccttctgggtcagtttgtatttagaaccggaagaaaaaagctcttggtggagttcaccgataggggtacctgtatatcccagagaagccaggacctgcatcatatgtacttcatacagggtagtacttttccgggcagcctcaaagagctgttctttcgtgatcggataatcttccatgagcttttcgtacatggcaagcttcgtctgccgctgatattccagataacggtcaagctttctctgaagcttctttacatcggcgggatagtagcagagaagatgaggttttgtatcggaagcctcgtgaacagagttgatctcgaccccagggatgacattgatcccaagttcttttcctagagcaagtacagcgggaatagagtgggtggaattgtggtctgttacggcgatataatccaggccgacgcgttttgcctgggagatcagctggtcgacgtttaaagcgccgtcggacagcacagtatgtgagtgaagatctgctttcatttttaaattcctcctagtaatttggctgattatattatatcatgaagataagcggatttaacagaaatacttattaaaataaaagactgatcagacagaaaaagggggctatcgatatgaatttagaagacttttatagaggaagaggcgaagattatccggttatcatcggaaggtttatgggaaatgaaaatcttttaaagaagtttgtcaagaattttccggatgacccgacctatggacggctttgcgaagcgatggaggcaaaagactggccgcaggtggaaatgtcggcgcatacattgaagggggtagcggcgaatctgagtttttcaaaactatttcaggcatcggcggacctggtcagcgtcataagagaacaagagacagagaaggcagatggattattttcagaagtgcagaaagcttacaaagaggtagtacagggaatatccgggctggattaaatttggggaaagagtatggaagcagaaaagcggacgcttttgatcgttgacgacgtggaattaaacagagcaatcttgaatgagattttctgtaaaaattattatattattgaagctgccaatggaaaagaagctctggatattattttagatgcgaggaaaaaagtagacttggttctgcttgatttagtcatgcccgtcatggacggtttcgtactgatggagatactgaaagaaaagggggtactggagcatctcccggtggtggtcatcacggtggacggttcagaacagattctggagaaggcatactccatgggggcggaagagatcatcatcaaaccgtttaaccccgatatcatcagggaaaaagtaaaaaatattttgtccatgtacataaggatggaactgatcagcagcatggggaagcttcagcacctgactgaggaagatacagaggatcagctttctgcggataccggcacaaaaacacggatcgatgccctttctactcggacgctgtatctccttgagctggagagggaaaagaaccgggtgctggcaaatctctccggggatattatgtttgattatgatgtaaagtcagatacgctttctttttcagaaaaatattttgaggtattcgggcgggatactgtgatcgaggaagtgagccggaagatcaggagaacggatatcatctatgacgatgacaagcaggtattggtgaacaatctggaagggctgagtacggacaatacaacgatgcgtgcacagatccggctgatgacaaaagacagcggatatctttggtatgagtgttttataaagtctatctgggatatggacgatggaatgtgtttgtctctgatagggaaattcgtcaatatagatcagcacaggaaagaaatctcccgatggaaagaagcggccgacaatgatgccttgacaggaatcaataatcgtaaagggctggaagaaaagatcttaaagattatgaaagagaatggggattcttcaggcgtactgctgtttctggacctggatgactttaaacagatcaatgacagcaaaggtcatgcttttggcgacaaagtgctgcggaccgtagcagagaagattaaaagctgtgtcagatcaaccgatgtggtaggcaggattgggggagacgagttcattgtttttctcaacgggatcggaggaaaggatgcggcactcaaaaaggcagaagagatagaacagaagattcaggacggctttcatggatatccggtaacggtcagcatagggatcgcacagttcccggaagacggagcagaatttgatgtattgatcaagagggcagatcaggcactttattactctaaaaataagggaaagaatcggtatacattttatgataagaagacaaaagacatgccgtttcagtcactgctctccaagatggacagcgatgaagatttataatatgagatcatcggaaatcaacgggcaaagatcgtttgatttcctttggtctcatttgttttggatcagatttttctctgatacattttctttataaatccggtcagggcgtacagaagcatagcgatgatgcataagagaacgatagacattagtacccaatccattttaaatacctggcttccgtagatgatcaggtatccaaggccggagcgtgctgccaaaaattctccgatgatcacacctacaagagaaagcccgatgtttacattcataatgcttaaaagcaatggaatacagctgggtatgactgccatggtcaggcagtctttttttgttcctccgagagtccggatgagtgtcaagcgctccttatctacgtggagaaatccactgtataaattcaggatacttccgaaaaccgcaatggagatggcggtgataatgatcgtcttcatattatttccgagccagacgatcaggatcggagcaagggctgatttcggaagactgtttaagactacaaggtatgggtcgatgatcttggcagccgtggggaaccaccataagatagtcgcgatcagcactgaaaataaagtgatcagcgcaaagcttacgagcgtttcagccagagtaaccccaatatgaagaaagatggaatggtctgttaccatgccgtaaaaacaccggatgatcctgcttggactgctgaaaataaatccgttcagtatattttttgaaaccgctgtttcccaggcaaataaaagaaggagaagcagaaggacctgggcaacccggatccaatattttttccgttgtatttggtttaaatactcggactgttctttagaaattggatcagtcattgatttccctccataattgattaaaataatctttaaattctactgcatttcttgcagcctgcggtgtttttttctcacatgtaaggtgaataggaacaatggtcttgacagttcccggacgtttggacagcacgatgacacggtcggccatactgatcgcctcagaaagatcatgggtgacgaggagagcagtttttttcttctcttttatgatggtgcctatatcatcggatacccggagtcttgtctggtagtccaatgcagaaaatggttcatccagaagaaggatatccggggacagggcgagtgtacgaatcagagcagccctctggcgcatacctccggaaagctggctcggataagagtttttaaagtctttgagtccgtaaagttccagcagacggtcaaccttatcaaatgcctccggatctttgatgttttgtatcttgagtcccagggtaacattttcataaatagtgcgccagggaagaagctgatccttctggagcatatatccgatatggtcggtggattcctcgatcggtacgccgttgattttgatggtgccgccagacagagggagcagactatttttactgcttcctcttcctagttatgaagtttttattcagcagccggttctgccagcggaatagtacggaatatttttctggattcccaggaaatcagacagcaaatcaggcaggcaccgtagaccgcaaaataagactggctcttcaaaacatcaaacagaactccgtatacggcctggccaagaggctgggaacacatggacagtgccatgatacaggagatgactttgccgatcagatgatgcggtgtaagagcctgcacgaatgagagcatctgcacggtaaacatcgtggagcaggccatcataaagaaactgcacagggtgattacaatgtaggctgccatcggaggaacatccagattcagcacgagtccgattggaaggagagacgctccgctgagcaagagcagaacatggaccccctggatattcagccgttttgcaaagactccggtgaggataccgcccaaaaggcccccgagggctaaggctccctgggcatacccataaagctggctggacatatggagaaactgtgtgatgatcacaggcaggcctacgatgagcagggcgcttaaaaataagttaaatgcgcagacaatcaggattcctttccctataacaggctgttctgtacggataaaccggaaactttctgaaagatcctgttttactactgcaaatacactggttcccttttttggctttttaaatgggatatggataaacagttccattgtggcagaaaatataaagcagatgatgctcacatataatatcgggcggattccgtagaagccgtataaggctccgccggccaccggaccgattagattggccagagcattgacctgattgatgactgcatttccggaaagcagacggtccggagtcagcagagccggaaggcttgcctggactgccggctggtatgcaccctgtatgccataaaggatcataagggttatgaccaaaagcatcaccagggatacatggccgagagcggcggtaaacaacaggatcagagcgctggttgcatagtcaagaatgaccatgatatttcttttgttgatccggtccgcaactatacctcctgcgggtgagagcaggatcataggaataaaggaacaggcggtgacaatgccgaacagggatgcggaccctgtttcatttaacagatacagaggaagtgcaaacctcaggatggaattgccgaacagagaaatgatctgtccgatcactaccagagaaaaatctctggtaaatagtttatctttcataaaaactcctttcatacattcggttggtatgtaaaattgataaaaaaatttgtagttctcaccaatctccaagaccggactgtatgagtccagtctgaggatgaatgagtcagcttttttcttccagctgttttcggtaagattcaagaacaaggagtgcttcgtcatccagcagaggcattccgagccggtcaagcagatctttcataaactgggttttgcggatgagttcttccgcagtattttggataataaatgggttcatccagaagttgcacaaaatgagaagtgcttctgacagttcttttggatatttagtttttacagaaccatcctgaatcccctgctctatcagcggcagtatcaggtggggcactgtattgtccaggctttcaaacagctgcttggtcaggaatcgtggatttttcataatatgaggagcggcattaatcatcatttgattaccgggacttttaattgatacgatgagaagttttcttaatttttcaagtcctgtccccggtccgttcaaaatatcctcatagtccttttcctgcccgctgtacaattggttcatgacggcttctatgatatcactcttggatttaaagtggtgatatatggcgcccttcgtcaaatcacccagttcgtcgatgatatcctgaatcgttgtgtgttcgtaacctttttccagaaataatttcagcgatgcatccaagatcctctgctctgtaatctcgggatatttatttcttgccatggaaaatcatcctttcttgcatacatactaatagtatgtatttaaaatagcagatacatggaagaatgtcaagaaattaaaaataatacttgctttttatatgctagatgttatactagatatagaacaaataagattggaggagtgaagatgaatattaataagtttactcaaaagtcagtcgaagcagtaaatcagtgtgaaaagattgcttatgactgccaaaaccaggaaattgaccaggaacatttattatatagtctgctgaccatagaagatagtttgattcttagccttttggagaagatgaatgtcaataaagattcttttttaagccaggcacagcagctgctccagaagaaaccgaaggtttccggcggacaggtctacatgagccaggcgctgaatcaggtactgctggcaggggaagatgagatgaaggccatgggagacgagtatgtctctgtggagcatctgtttcttgctatgatcaaaaagccgaacaatgcagtgaaagaactgttcagaggttatggaatcaccagagaccgtttcctggaggttttgtccgaagtaaggggagataagaaggtaaccacggacaatcccgaggcaacctatgatacgctggagaaatacggatacgatctggtgaagcgtgccagagagcagaaactggaccctgtgatcggaagagacagcgagatccggaatgttgtccgtattctttcaaggaaaagcaagaataatccagtgctcatcggagagcccggtgttggtaaaactgcggtcgtagagggacttgcccagaggatcgtccggggggatgtgccggaacagttaaaggacaagacgattttctcactggatatgggatctcttgtggcaggcgccaaatacagaggagaatttgaagaacgactgaaagcggttctcgaagaagtgaaaaagagcgagggacagattatcctgttcattgatgagctgcacacgatcgtgggagcgggaaaaacagagggctccatggatgcaggcaatatgctgaagccgatgctggccagaggagagcttcactgtatcggagcgacgactctggatgagtaccgtcagtatattgaaaaagatgcggctctggagagaaggttccagccggtcatggtggatgagcctaccgtggaagatacgatttctatcttgagaggtatcaaagagcgctacgaggttttccacggagtaaaaatcacagatggatctttggtggctgctgcgaccctgtcaaaccgctatatcacggaccgttttcttccggataaagccattgacctggtggatgaggcatgtgccatgattaagacagaaatgaattcccttccttcagaactggatgaggttcagaggaagatcatgcagctggaaattgaggaagcggcactgaagaaggaagacgataatctgagcagagaacgcctcctggaacttcagagagaattggcagagatgagggaagatttcaatgccaagaaggccacatgggagaatgaaaagtcttccgtggagagggtttccaaactgagagaagagattgaatctgtaaacaacgaaatacagatcgcacagagaaattatgatttgaataaggctgcggaactccagtacgggcgtcttccggagttgaaaaaacagctagaagaggaagaagagaaagtacggaaagaggaccgctctatggtcagggaaagcgtcacagacgaagagatcgccaagatcatttcccgctggacgggaattcctgtggcaaagcttacagagagtgagagaaataagacactccatctggatgagatccttcacaagagagttgtggggcaggacaatgcagtgcagcttgtgacggactctatcatccgttccaaggcggggatcaaagacccgagcaagccgattggttctttcctgttccttgggccgacgggtgtaggaaagacggagcttgccaaggcactggcagagagcctattcgacaacgaacagaatattgtccgtatcgatatgagcgaatatatggagaaacactccgtagcccgtctgatcggagcgcctccgggatatgtaggatatgaggagggcggacagctgacggaagcagtcagaagaaaaccttactctgttgtactgtttgatgaggtggagaaagctcatccggatgtgttcaatatccttctccaagtgctggatgacggaaggatcacagattccaagggaaggaccgtggactttaaaaatacgatccttatcatgacatccaacattggttccacctatctgctggaaggcatcgaccaatccggtaatattacaaaagaggcggaagacatggtgatggcagacttaaagaaccatttcaggccggaattcttaaatcgtctggatgagatgatcctgtttaaaccgctgacgaaggaaaacattacgaacattattgacctgttagttgcagatttgaataaacgtctcagtgacaaagagcttgccgtagagctcacaccggcagcgaaaatctttgtggcggacaacggatatgacccgatgtatggtgccagaccgttaaagaggtatctgcagaagagcgtggaaacattggctgcaaggctgatcttaggtgatggggtcaatatggaagatacgatcctgattgatgaacaaaacggggaactgacggcaagggtgaaataagaagatatataaaaaggctgttttgaacaacagcctttttattgcaacactgcttgcctgcatagataggaaaaacaagcgtaaataaataagcctaccttgaacttgtcggtctgggtaggcttatgcacaaaccggaggctaaccacctcagtgggcgatatgctcctttctttacttatactatgctgtttttttggtatttttgtaagaggtttcggagatttcgctgaagattctctattcaaaattctccgtttacaaaaaaccataatggtccagcccattccaaattccatgtgcgtcaatgtcggttgttacatactctgctgcatcttttacacagtcatatgcattcccgagagcgatgccgtgtcctgcggcttcaaacatgggcagatcgttaggggcatctccgaacgcatagcagtcatcgatcgggatgttaaagtgttccgcaataaaagtaatggcagttcctttagatgtgccttccgggataacttcataaaaatcttcaccatttttgatgcacttgaacggaaagtccagggagtgaacatcttcaataaaggcggccatattctgaggcgtatccgggctggaaaagcacaccagtttatcaaaagattttacattgtcccagttaaattcgatcaccatgccgtcagaacttctgcatacctggatcatagaagcgtaatagggatggaacgaggtatcatcgtcagtgtaataggaacagcggcttccttccagacaggcacggatgttgtggatgcggcataactctatgatccgggattggatatctttcggaagctcacggtggtataggatatctcccctgtagcgcagatcggtgccgttgccgcagaggtagccgtcgaaatccagggaaaagaagtcattccctatatatgcataaggccttccagtattcaaaaagattttatggccgttcgtctgggcctgctttaatgccttggctgcactcggcgggatctgaccggttttgttgctgtataaagtctcatccacatcgaaaaataaatatttatgttccaaaagtgttcctccctgtctgatgtattatctttactgtgccaaaagaaatgcttagaaccgcacggtgtcctaagcatttcaagtaagtcttctaatattttattcttctacggtcacagatttcataacctgtttttccaacggcgcgtcagagtagtccgttgccacctcagcgagtttattgacgacatccatgccctcgataacctgtccgaatgcggcatattgtccgtccagatgcggagatgttttgtgcatgatgaagaactgagaaccggcagaatccggagccattgatcttgccatggataacacgcccggcgtgtgttttaagtcattctttactccgttcatgctgaactcacctttgatggtgtgtcctggtcctccggttccgtttccgttcggacatcctccctggatcataaatccggaaataatgcggtggaatgtgagcccgtcataaaaaccttccttcaccagcttcacaaagttttctactgtgatcggagcgatatccggatacaattctgccttgatcgtatctccgttttccattgtaattgttacgattgggtttgccataattcctattcctttctatatcttcctatataactgattatataggaaaccaaaagaatgtcaatgaagttacaaatgtattaaaaatattaaaaaaatctaataaaaagggtggtatttcagaacaatatcagtataatgagagataatcagtgtcgaattatggaggaatttatggggttaagtttttacgaaaagaaaaagaaatcaaaaaaactatggattttgctgctggttctggtcattgctgcactgggtgcggcctgctggatgttcaaagtgaaacaagaagagcgggaactggccgcgagaaaaaaacaggaagagcggacggtcaggatcacgataccggagggctatacggcagaacttgcggcgaagaaatttgaacagaaagatatctgtaaggctgaagattttttgaaggcggccggtgatctcgacggttattcttatgaatggctggaatcggtgccaaaaaaggcacaggtaagctataaactgcagggatttttatttcccgatacttatgaggtatacaagcataccgatgccaaaaagatcgtggctatgatgcttaacaattttaataccaaatgggagcagatatccaaagaaaaaaagaccggtctcaccccgtatgaaatcgtgactcttgcgtctgttgttgagagagaagctaaggtggatgctgagtatgccaagatttccggtgtgatctacaatcgcctggacaaaaaaatgaagctccagatcgatgcaaccgtgctctatcctcttacaaaagggaaatataataagaaaagaacgctgtataaagacctggaagtggattctccatataatacgtacaaaaatcaggggctcccggcgggaccgatctgcaatccggggatcaatgctttgaaggcggcagtttctccacagaaacattcttatctctattaccatacagataagaccggaaagggaactcatattttctcagaaaccttcagtcagcacgaagaatctctaaaaaatcaggcaaaatagacaaaagacactgttattttttggacaagattttttctggaaaaaaagattcataaagtactaaaaaaaatacgaagaaatttagttaaaatcctttaaaaacccgttctaatgatgtaaaataaggctgtatgcatgattgtatacagttttattttgttctaaacaacggtcccgttgttgtgataacatcctgtctcctctgtaaggagaagggaaaaacttaagtgtagattgttaatatttacacaagatttttaggaggaagaaacatggcaagaaaaatgaaaaccatggatggtaacacagccgcagcacacgtatcatatgcgtttactgagacagctgcaatctatccgatcacaccatcctcaccaatggcagaatcaacagaccagtgggcaacacagggaaagaaaaacatttttggacatcctgtaaaattagttgaaatgcagtctgaagccggagcagcaggaacagtacacggttctcttgcagcaggtgcactgacaacgacttacactgcatctcagggattactgcttatgatcccgaatatgtacaagatcgcaggtgaattaatgccttgtgtatttgatgtatctgcacgtgcaatcgcatctcatgcactgaatatctttggtgatcactctgacgtttacgcttgtcgccagacaggttttgcaatgctttgcagctccagcgttcaggaagtcatggacttaggcgctgttgctcatttatctacaatcaagggaagtgttcctgtattacatttcttcgatggattcagaacatcacatgagatccagaagattgaaatgtgggacaacgaagatcttgcagatatggtagattacgaagcacttgaaaaattcagagcaaacgcattgaatccagaacatccggttcttcgtggatctgctcagaacccagacattttcttccaggcaagagaagcatgcaacaaatactacgatgcattcccggcgatcgttgaagattacatgaaccaggtaaatgctaagatcggtacagattacaaattattcaactactacggagctgctgacgctgaatctgtgatcatcgctatgggatctgtatgtgagaccatcgatgagactatcgattacttaacagcaaaaggcgaaaaagtcggtgtcgttaaagtaagactttacagaccgttcgtagctgaaaaattagtggaagtgattccggaaactgttaagacaatcaacgttttagacagaacaaaagaaccgggatctcttggagagccattatacttagatgttgtttctgcattaagaggaacaaaattcgaacaggtgacaatcaacggaggacgttacggattaggttccaaagatacaactcctgctgatatcatctctgtattcaacaacaaagacaagaaagaattcacagttgcgatcaatgatgatgtgacaaacttatctcttgaaagaggagaagctgtttcttctacaccggaaagtacagtaagctgtaagttctggggacttggagcagacggtactgttggtgccaacaagaactctatcaagatcatcggtgatcatacagataaatatgctcaggcatactttgattatgattctaagaaatcaggcggtgttacaatttcccacttacgtttcggtgatgacccaatcaaagcaacatacctgatcaacaaagctgactttgtagcttgtcactgtgctccgtacatgacaaaatacaacatggttcaggacttaaaagacggcggtacattcctgcttaactgcagctggccggtagaagagatcggagatcaccttccgggacaggtaaaagcctacatggcaaaacataacatcaaattctatgtgattgatggtatcaagatcggtaaagaaatcggactcggcggacgtatcaatacagttcttcagtctgcattcttcaagttatcaggaatcattccggaagcagacgcaatccagtacatgaaggacgcagctaccgcttcatacagcaagaagggtgaccatatcgttaagatgaaccatgatgcgatcgaagctggcgctaagagcgttgtagaagtaccagttccagctgaatgggctgactgcggtgaagaaagcttactgcacccagtatccggggacagaaaagatcttgttgattacgttaacaatatccagaatgctgtcaacggccagatcggtaactccttaaaggtaagcgacttagttccttacgctgacggacatatgcctcagggatctgcagcatacgaaaaacgtggagttgcagtagacgttcctacatggaatccggacaactgtatccagtgtaacttctgtgcttatgtatgtcctcatgcagtcatccgtccggtagcgatgacagaagaagaactggcagcagcaccggaagctacaaaatctcttccgatgaccggaatgccggattataaatttgttatgacaaccactgttcttgactgtacaggatgtggttcctgtgcaaatgtctgcccaggaaagaaaggcgaaaaagcccttactatggtatccttagacagcatgaaagatcagcaggaagtttacaattacggacagtctttaccgatcaaagaagatatctttgacaagtttaaaccggaatctgttaagggaagccagttcaagaaacctctccttgagttctccggagcttgtgcaggatgtggagagacaccatatgcgaaactgatcactcagttattcggtgagagaatgtacattgccaacgcaacaggatgttcttctatctggggcggttcttctccggcaacaccttacacagtgaacagagaaggacagggaccggcttggtcaaactctctgtttgaagacaatgctgagttcggtttaggtatgttcacaggacagactacactgagagagcagacaaaagaaaaagtagctgccctggcagaaacagcagaaaatgcagatgtaaaagcagctgcagcagagtatttagacacttacacagacggcaagaaaaacggagcggctaccaagaagttagttgcagcgttagaggcatgcggatgtgatgaaggcaaagagatccttaagatgaaagattacttatctaagaaatctcagtggatcttcggcggtgacggatgggcttacgacatcggattcggtggtgttgaccacgttcttgcaagcggcgaggatgttaacatctttgtattcgatacagaagtttactctaacaccggtggtcaggcatccaaagctacgccggcaggagcgatcgctcagttcgcagcagcaggtaaagctgtgaagaagaaagaccttgcggcaatcgcaatgagctacggatatgtatatgttgctcagatttctatgggtgctgattacaatcagacagtcaaagcaatcgcagaggcagaagcttatccgggaccttcactgatcattgcttacgctccatgtatcaaccatggtatcaagggcggtatgagcattgctcagtctgaagagaagaaagcagttacatcaggatactggaacttattccgtttcaaccctgaattagctgaagaaggaaagaatccattctccttagattctaaagagcctacaacagagtacaacgacttcatcatgggagaagttcgctacaacgcattggctcgtcagaaccctgagagagcaaaagaattgtttaaacaggctgaagagaatgcaaaagaaaaatatgctcgtttgaaagaattagcagataaataaaatatctttagcaaagacgaagaaaccgggacactgatcaacagtatcccggcttctttttttattctacaattttgttgttgataagtaaacttccatctcatccgttctctttttgagattgggggaaggttttggagtctgcgtcaataaacatattttgaccgcatagaggagcgtatcacatatggccatagaacataaatgtgataaaggttcttttgtctcattgaacaaagggtgttcttcgctgctggacagaatatgatcagagacccttgccaaaggtgagtcactgtccgaggtaatcgatatgatcgtcattccgatatcttttgcgatatcagcagcctgaagcacttgttttgaagttccggaaccggaaattgcgatcacaacgtcttctttgctgccgaggctgacattgttcaagtagtactcggaaatggaactgctaaaagactgaacaccaaaccgggaaagccgaaaacttaaatccaacgcaatcggtgtcgtgtttcctgtggcgatgatatgaaccgcaggagctttaagcaatataagagcacattgcagcagtacatctttggacagattggatgagaggtttcttaagttttgaatattgcgctcaaacgtataagaaacaaagtccgtatctgcatcaatgccaatatcattggattttgtgccaatatctctggataaaattaaacgcagctgatagtatccctgataccccagatgtttgcaggttcttacaaccgttgcctcgctggtgccgctggctttggcaagttgggacacgttcatcatgacaacttcatccgggtggtcttttatatagtcggcaatttgcttctcctttgaaaataactgttgataaaggttgtcgatgctgtctaaaacattggtttcgcttgacatacaacctcctttcgttgttggtggactgccatgcatataagctaattatagtatagactggatagaagacgcaagacaatccaaaataaaatagcagctggttgcgcctgcatcaagaacaccgcggcttcgctctcccagacggcttgcccgtccgattttagctgtcatgtttttggtggattcccatccttttttagcggcattcctcatggcatccagacattcagaaaaatctttccctgcttctttttctgccatgaaggcttcttttgcaggaatcagagtatcaagaagagtcttgtctccaggctttgccgggctgatttcctggattccttccacggctccggtgatcatctctccgaatatctctgcatcaatctcctctttatcttcgcttgccgcagaaagctcatcaaataaaagtccgtatagcggccccatggaacctccaatgtcctccagcagagtctctccaagagtacacaggccttggctcatgttataggtctggcctttcagtttatcaccacacatggtaaaccctttgttcatattgatgccgtgatccccgtcaccaatctttccgtcaatctcgcttaaatagtctctttgttcctggatcgtcttgattaaatgatcgacgataacgcctgcatctgcatttttaaaacttgacataatctttctccttattatcattcttatcctcgccaacaggaatagctgtacagttcattctggattctcatgtcagttccctgcagctgttttaaaccgacagagtcgcagggcatgtcgatgcattccttcagttcatcgtcaagcttcatcacagtaagtgtcacacccatcatctcaagggaagtaaagtaattacccacatatgccttgtgaacactgattcctttttctgcgagaacttcttccacacggtcatagacgatgtactgttccatcaccggagttgcccccaggcctgacagaagcactaccacttcgtctccctctgcaaacggcaggtccggaaggataatatccagcatctcgtctgcgatctcacttgcagtctttaatggctgtacattgattcccggctccccgtggtgtccgattccaacttccatcgttccgtccttgatctcaaagttcggatgccccacagcagggatggtacacggtgcagttccgattcctacggatctcgtgttgtcgatcgctttctgtgccgctgcgatgactccgtccagatcagcacccatagaagccttcgctcccccgactttccacatgagcacttcgcccgcaacaccgcggcgtttttccagttcatctttcggtgcagacgcacagtcatcatttgccacaacagtctttacttcaattccaagcttctttgcttttctcatagccatcttgacgttcatgttatcgcctgcatagtttccgtaaaggcacgcaacaccttttccggaatcagcctctttcatggcatctaagaaagcctttgcagtcggtgatgagaaaatttctcccacggctactgcatcacacatattcttaccgatataaccgatgaatgcaggtttatgcccggagccacccccggtgacgattcctacctttccttccactggtgcatccttatatttcaggacacgaggatcttccgtaggtgccacaatatctttatgtgtctttacaaatcctttcagcatatcctcaacagcgtaatcaggattgtttacaattcgattcatctgttctccctcctatatctcagcagcgatggctttcagatttttcagcccttcaatcgcaagttcttctccagtatcggcaagttttctccagatcgcacagttgccggacagttcttcaaagctcggatcaaaagattcgatcaccaaaggtccgtcatacccgatctctactaatgcattgaaaaattctttaaacggtacaagccctgttccaggaatacctctgtcgttttcattgacatgaatgtatccgagatattctttgccgcaggtctttactgcccctgcaaagctcttttcttctctgatcatatggaagcagtcgagatgaaccttgacatttcctgttccaacatccttacagaaggccactgcatcttccgcaatgtttaagaagtgggtttcaaatctgttgacacattccacacagatggtaacatctccggtttgctttgcgtactcggcaacttccctcatgcactctacgccccagttccactcttcctcggtccttggcttcttcgtcagatatccccagcctgcataatttacaccgcctaagatcggtgcacccagttcgttgcagatatccacacattttttcatggcttttacgcctgccgcacggatctcggcatccggagaaatcggattggtttcaggtgtcagcgtggtagtgcagacacagtcgattcccactctctctagctctgccttcactttctctacagggaatgtgaatgggttggagatcgcaaagtcgatgacttcaaatcccagttcttttgccttggggatgatccataaatcttttttagaaaaggattcagtccaaataaaactgtcaactccgaatttatttttcataagagctcctttcagttagatgctggctggtacttcaggattgttatttgcatagttctgaagaattactagagattcataagaactggtgtttttaaccataacgcctttttttgcggctttttcagaaacaaaaaattcatcaccggaaatatcgtcaaaatggagcagccccggagcctcgcattcaaaacagccgaaagttccgtggccctgtgtgatcacagcaccgtatgcagcctgatcagtgatagtataagtttgtccggggagtatggtgacttctttcgcagcgacaaaatcatttgcataggcaacccacttttcaatagctttatttgattctgtcttgattttcggcaaacggaagtaggtttctttataatcagggcgtgtgctttcctcccagtcgatctgagcaaaaatagcatccaggtcatttttttcttctttcggagcgcagtcggtcagaagattatgcgggtttacttcacccatagttacattttccataatagtatttacatcactgttccactggggttcaaaggttaccacagaggccggggcatggataataccggccggagtataccatcctgttcctaacttaacgcggtaggctctggaaagttctgtgattcttgtgtcttttatgtcataatttttcaggcattccataacatcctctttggttgtggacggatcaaaaccaaaataagtcagaggaaatcttcccagataagaagcgttatattgcggcgggaagtagtaggcttccggctttccgtgcattccgattttatttgcgcgctcttctgtcaaatggagatggtggaatagaggcttgtcatagtcatacaattttgcaaagacaggccaggttccgtacttttccatcaatgtttccccgatcagagaagaacccaactcctctacaaactctgagagaagtattttttcttctgtttttttatctgcaagcacgtagctcatgccttctgtctctccggtctcaggaccattgagagcctttgttatggaaccgagccagcgttcgcagattcctccccggctcatgccaagtgcataatagtcatcgggatgaaggcgaagcctgtgtcctggttcgttgaatccccttggcacccaggttggtgtaagctgtaaaataccttttcccgcttcaaatactttcttaattgttgacattctcattacctccttaatatatttaaagtgatattaaccaaataaaggatgtataagaaataatattttctatataagaaataatatttcataaaatcctaaatttaaatgaatattagcatattttttgcaatttgtatatagaaaaacgaaaaatacaaaataatatttcatgaaatgattgacaaacatcataagaaaagttaatataataatatcaaaattaacaagggcaagatgtatctataaaattcctttgtgaagagtagctaaaacatccattaaatttaaaaggagatttcattatgttattgaacatgaaagatttattggcagtcgcgaatgaaaagaatttcgctgtaccggcatttaatattggtaccggacagattttgaacgcagttgttgaatgctgtgaggaaaagcaggcgcccgttattctggcgattcatccgaatgaattggaatttcagggcgacagctttattgaaatgtgtaaggacaaggctaacaaatcccgtgttcctatgtgtatccatttagatcacggggagacgatggagcaagtacagagagctatccgctgtggatttacttctgttatgattgatgcatcaagcaaatcatttgaagataatatttccattacaaaagaggtgattaaagtcgcccacccgttaggcgtatctgtagaagctgagcttggaaccatcggggatatcaaagaggattcaggaaaccgtgagatcggagcaaaagagatcgtatttacacagccgaaagacgcaaagaaatttgttgaggaaacaggatgcgatactctggccattgcaattggtacggctcatggcatttatccgaaaaattttgtgccacacttggagcagaaattgctgacggagatcaaaaatatagtttctattccattggtacttcacggaggttcagcaaacccggattcagaaattgcagaagcagtaaaacggggagtaaataaaattaatatatcttctgatattaaagatgctttttatcagcagacaagaaaaactttggcggatgatgctgtcatcagagaacctttcgatctgtatgtagaaagtattgctgccatgaagaaggttgtaaatcaaaaaatcgacttgtttgatgatgcggataaaatgaaatattacaaattataatcttttttgaaaggaagaagccatggatattaagagtgttttagacgacagagtgatccgttccgatcttttcgcagtcaataaggaagatgcgctggaaaaaatgacagaaatgctgcaaaaggcaggatatgttgatgatgcagccggatttattgcagatgttatgcaaagagaaagtctgggttgtacagggattgggaattatgtggccatcccccatggaaaaagtccgtccgtatcgaaagttgggatcgccatcgtaaagcttcagaatgagattgagtgggaaaccaatgatggaagaggagtcagagtcatctttttgttcgcagttggaactgataatgagaatgctatgcagcatttaaaactgcttgcacaagtagcaggaaaactgggaaatgacgaagttgttgaaaaactcttaaatgcaggttctgttgaagagatcaaaacgatatttgaataagaaaggagcacctatgaacattgttggagtagcggcatgtacggctggaatcgcccatacatatattgccaaagaaaagcttgagaatgctgcccgaaagagagggcacaagattcacatggaaacacaaggggtgatcggagttgaggatgcgttaagttccggggagattgaaacagctgatgtcgtcattctggcaacggacgtaagcatttccgggaaagatcggtttgagggaaaaaaggtggtagaagtgcctacagagacagtggttatgtctccgaataaattaatagaaaagatagaggagcttgtataaaatatcatagaaggagatatataatatgaaagaattgcaaataaaaaaacatatgctcacggcaatttcatatctgatcccatttgtatgtactgcaggtatgctgatggtgatcggtaacattgcaggaggaaactctgtagaagactttacaaaacagcttgctttccctgactttttgacaactatcggcggaactgcactgggatttcttccaatcgttatttccacagggatatcttttagtatagcagataaagccggtattgctcccggtatcatccttggactgctctgtaaagatgcgggatttggttttttaggagggctggtcagtggttatctggttggatatctaaccgtttatctgttaaaggttatgaaagtacccagatgggttgcagggttgttgcctcagttaatccttcctctgatcggatccctggtggtagggctggtcatgaaatatgtgatcggaattccgatcaatgcgctgaccaatgcgattacaaatcttttggtgaatatgcagaccaatgcgggaatgatcatcccgtttggaatattggttggaatattgtcggcagttgattacggcggcccgatcaacaaagttgtgtttgtttttgcatgcggtgttatggcagagggaatcggtggacccattgcgattttgatgcaggcatcaatgatagcgccgtttggcctgacgattggatatttcttatctaagatcatgaagaaagatattttttctaaggaagaagtggacaacttgaaatcagcatttgtcatggggtgctgtatgataacagagggatcttatcccatcattttaaatgacttgattcggattacaatttgtaccggtgtaggtgccggcgtgggcggtgctgtatgtgcggctttgaacgttacatccaaggttcccacgggagggctctttgcacttccgggatttaaccatccgcaatactggcttttggcattattaatcggttcctgtgtattcgcggtactgcttcagttccttaaaagaaaacctgtcaaaggaaatgttgaaattgaagaaaaagaaattgatttgtcatcattaaagatcagttagccaaataaagtttaaccttgattttacaaggatttaacataattctccacgaaaatcatgtaaaataaaattgctgttaaattttatagaaatttatgtgagacaaaggagaattaaaatatgaatacaacgattgtaatgggcctgcttgggggacttgccctgttcctgtacggaatgcagatgatgggtgcgggacttgaggcggccgcgggaaaccggatgaaacgtatcttggagaaactgacatccaaccgatttctgggagtagctgtaggtgcgggcatcacggctgtcattcaatcatcttcggctacaacggtcatggttgtgggatttgtaaattccggactgatgacgctcaatcaggcggtttggatcattatgggagccaatatcgggacaaccattaccggacagctgatcgcacttgatgtaggagctatggcaccgatctttgcatttgccggggtagcaatggtattgtttctgaaaaaacccaagattcagtacataggacagatcattgccgggctgggcgtcctgtttatcggtatggatatgatgagtacagcgatgatgccgcttagagatgcacctgcatttattaatcttatgacgaaattctcgaatccgatcgtcggtattcttgcaggagcgggatttacggcattaatccagtcatcttctgcatccgtaggtattcttcaggccctggcagccagcgggctgatcgggtttaacagtgcagtgtttgtattattcggacaaaatataggaacatgcattactgcgattcttgcggctatcggaacagggagaagcgcaaaacggaccacagtgattcatctgctgtttaacattattggtacagtcattttcacaacagtgtgtctgaccctgccgctgagtgatttcgtggcagcatggacgcctggaaatgctccgagacagattgccaatatgcataccctgtttaatcttgccacaagctttcttctgatcccatttggaaatcagctggcatctctcgcagtaaagattctgccggaaaaggaggcagaaaaacaaaagcagaagcatctaaagtacttaagaagctgggatgcagggctggaccccagaattggaggtgctgccatccacatggaggaagtgggaaaggaaatccgcaggatgcttgagatggcaaaggaaaatgtggatgaaagcttccagtcttttctggttgggaacagccataaattgaaggaagtggaggagagggaagaatatattgattacctcaataaagagatctcagggattatttcaaagatgatggtatctgagacgaacgagaaaacttccgagctcatcagtctgtattttaagatgacaggaaatatagagcgcatcggggatcatgcagtaaatatttgtgactatacaaagattatcgaagaaaaagagattaaattctcacgtcaggcaagagcagagttaaaggagatgaagcagatctgccacaacatgttccgctattttcagagagagatcgaggacacaaagaaatggcttgaggatctccatgagatggagcgctttgtggatacgaaaacccaagaattttacaacagtcatctaatgaggatgaaacggggagaatgtaatgatgaggcatgtatcatttattccgaaatgctggtagattttgagcgtatcggtgatcacctgtggaacatggccaaagctatgagggaaattgcagaggaagtttagtgttaaggggaagagcttttcttccctttttttgtttcagttatgatataatacaactgttagtgtattagaggaaaaaaggagaaggtagcatggaatacattttatcgccgtcgattttatcggcagatttcaagacacttggtgacgatatcaaaaaagcggacgctgctggggcacagtgggttcatattgatgtgatggacggagactttgttcccaatatttcatttggaatgccggtcatcaagagcatccgcagtgcaacggacaaagtattcgatgtccatctgatggtagaggagccgggcagattcattgatgaatttgcggcatgcggggcagactatattacagtacatgcagaggcgtgcacccatctcgggcgtgtaatccagcagatcaagcagaaaggctgcaaagtgggagtttcactgaatcctgcaacttcgctgagtgtccttgactatgtgctggatgatcttgatatggtacttatcatgtcggtgaatccaggtttcggaggacagtcttatatagaagcaatggatcagaagatcagggatctgagaaaaatgattacagacagaggactcgatgtggacattcaggtggacggaggagtgacagctgataatatcgctcatatcaaagactgcggtgcgaatgtattcgtagccggatctgccgtattcaacggagatattgaacaaaatataaagaatttatttaaagcaatggaggtatagagatgagtgagtgtactcacgactgcagcagctgcggggaaagctgttctgacagaacgcagtcacagacagattttatggaaccattatataaagacagcagtgtaaaaaaggtgatcggagtagtgagcggcaagggaggtgtggggaaatctttgaccacagccctgcttgcggtggcggcaaacagaaaaggcctgcacacaggtattctggatggagacgtgacaggaccgtcgattccccaggcttttggtctgcatgaaagacttttgggcaatcaggaagggattattctgcctgcgctcacaaacttgggtatcgaggtggtgtcagtcaacctgatgctggaagaggagactcagccggtgatttggagaggtccggtagtggccgatgtggtcaagcagttttggggcaggacattatggcgtgacatcgacgtgatgtttgtggatatgccgccgggaacaggggaagtgcctctgacagtattccagtccgtgcctctggatgggatcgttgtggtagctacccctcaggatttggttggaatgatcgttgaaaaagcggtcaatatggctaagatgatgaacattccaatcctcggaatcgtggaaaatatgagttacatcaaatgtcctgactgcggaaaagagatttctatttttggagagagtcatatcgacggaattgccgaaaagtatcagatcccagtattaggaaaacttccgattgatccgaaacttacaaaggcatgtgatgaaggtttgattgaagatgtagaggaactttatttggacggagtgatcgaaactctgtaaaatttgttgtacacataatgtcgaattattttttgtattatcagattagaatgaaataaagaaaaatattaatgaaaaaagagatgaatccgatggatttgtctctttttttgtaatgaatttgtaatattatattggggaaatttggtaaaaacatgttctttttttaatacaacggttgacaaatcgtcaaatgttaagtaaactagcactaagttgttacaaaaatatttcaaatatttaaaaagtaagaataaattttaaaaaactatcataggttatacagtaaccgaaatgatttgatttagaaagaggacattatgaaatttttaaaaatagcagcaaagaaaaaacttttactgcttgccatgatggcagcagtagtgacgggtgcactgttcaccggttcatcatccacagaggcaaaagctaaaaaagtacagtacttaggaaaatataaattgacagcatactgcggatgcagaaaatgcagcggaggatatggaaacaaaactgctacgggaagaagagccaaacaggggcgtacgattgccgtggataagagaaagatcaaactgggaagcaaggttaaaattaagggtaaaacttatgttgccgaggatgtaggcggcggagtaaaaggaaaacacattgatgtttactttaaatcccataaaaaagtaaaacagttcggacgtaagaacaacgtcaaagtatacaaaattaaaaaataagtgagaaactgctgtacatcgtatccaaatgtacagcagtttttttgttgcttaggaatgattttgtcctatttttctttaaaaatgttccggatacagcccttcagatctcatggtcttaagggcatccatgacatgctgtttatcttccttataggtcacaccgtaccattggtctttggagaccagaacgtccattgtagcttttccttcctccatcagctggctggccacgcttggaataaagtattcacattttaatgggttttcttttagggaagcagagaggaattttgaaaaaccagtctccaattcatccatgatcatagggcggaagccaaaaaagttcattgatacgagagtgtcaaacgggagggatgtccatgagtttccgtcatcttccgtaaactcagcatgatccccgcgtttttcaatatgagtccgctctgtgatagagactaactgatggtttttatctacctcacagattcctctggagacatatccgctgtctgtcacggtatttccaagatggtatccgaccattgcaaattttgctttggcggaagaagattctttcataagaaactgggccatagcctgataaccgtgtatgccgtaataatcatcggcattgataacggcaaatggttccgcaataaatggcttggcacagagaaccgcatgggcagtaccccatggttttaccctgccttccgggacagagaagccggcaggaaggctgtctacttcctgaaaagcatagcagacttccattccgtccggtatcctggaacccactgtctccttaaaatctttttcaatctctttttttatcacaaacacgacttttccaaagccggcccgttttgcatcataaatagaataatcaatgattgcatgtccctggtcatccataggatccatctgcttcagcccgccgtatcggctgcccatgccggcggcaagaatgactaacgctggttttttcacttttgatacctccaaatcaatttctgaacaacattataccttatcgtgcgaagcacgtccacccgaagggtattgaaatacggtgtgccctgtgggtataccttatcgtgcgaagcacgtccacccgaagggtatgaaatacggtgtgccctgtaagtatgacattttccacatgatttccgttcggctcttagaatgcctcactccaatcatgtagaaaatggacataatatctgctggagcaggctgcttagaaaccaaaggtgccacttttcgaaagttatttaccactattggaggagcgcatttcaaaagcgcgacggaaatagtagtgaataactcatgacattttccacacgatttccgtgcggctcttagaatgcctcactccaatagtgtagaaaatggacataatatctgctggagcaggctgcttagaaatcaaaggtgccacttttcgaaagttatttaccactattggaggagcgcatttcaaaagtgcgacggaaatagtggtaaataactcataccttatcacaggaagcaggttcattcgaagagtatgagaagtgatatgaaacgtacagagaggccgtttgagtttcccaaccccggaacaggcagaaaacctgataagcggcgtgaaatggcggattagagatagttttcgctgagaagcgaataaaattaaaatcgttggtactaaacaaaggaaacgttgattttatcaggaaaactggctataataaaaatcagaaatggcttaaaagcgttggataaacaataacaagagttgtattgaaatatatcagagttttcaacatcgctgacagggatcagataaacaataacaagagttgtattgaaatttgtgacccctccatcccctattacaatgccttggagataaacaataacaagagttgtattgaaatgaggttatagacgataaaacagtcgtctatattacgataaacaataacaagagttgtcctaaaagcattagtgaagttcaataaaacaatattctgcttaaaattaacaatctttctttatcccaaagatccggttccccggatctttattacatagttacaaggatacctgatttttgacagagatctttttttgaccagttacagccacgatgatcaccagttgcggaataggatcccgttaaggtataatgatatatatgaccagcggatatagatgcaatacaaaagagggatttgaatgttaaaccaacgacaaattgaaattttattagaattctgcaatcactccgatgagttcctgactgcgtctcattttgcaaagaaactggacgtgagtctcaggaccgttcagggggacatgaaagtgatccgaaaggaacttgcggatgagacatgtgcggaattggtttccaaggcttccaagggaagctgtatccaagtgaaaaactatgatgagttttccgcattcgtgaattctctgtaccagcagtacacaacagtatctcttaattatcctacaagccggatcagcaagatactgcttttgcttctgaacagacacagggctgtatctgttatggaattggaagacaagctttatatttcgagatccacactgcagaatgatttaaagaaagtagaggaagtccttgaaaagttccagctggaactattaaaaagcagcaataaagtcatgattgacggatatgagatcaataagagacgatgcctggcggaacaggatctctatctggcccatatcaaaaacgaacagggcatggtatatattgatgagagacagcttgcaaagattaaaaatatactgactgatatttttgtaaactataagtatcacattatggacacggacttcaacaatgcgatcctgtttttaaatatcatgatctgccggatgggtgaaggattttacatacagccgggcgaactggatatttcggaacagctgggcaatgaatacgagatagccaaagcagtcttcgggaagatcagccggagattcttcataaaagtaccggatgaggagatacggtatttttctctatacttgaagggacagggaaataacagagattccgatacgattactcaggagatggataattttatttctgaagcttttgaagaaatccggcggaactttggggtagattttacggacaacataaatctgcggatcacattggcgctgcactgtatgtcattgagtatccgaatcaaatatgatatgcaggtcaaaaatgatatgctcaactatatccgggagactttcccgcttggttatgatattggggcttattttgcatttctgcttcatcagcagtatggaaagagggtgtcagaagatgaagtggcgcttctggccgtccatttttacagcagccttctggaattgaacagccgccaggggaataaacggattctcgtgatctccgctttgaaaaacagtatgacgcttttgatgaaacagaccctgctgaaatggttctcggagtatgtctctgttatagacttcgtcaatcctatggatgtgacggaagacatgctggacgaatatgatatctttctgaccacagaaaaagaagaattttttgagaaggggctggcaatgtatgtggatacattccccaatcagcatgattatatgaatattaagctgaatattgatggatttaaggatatagaagatgtggcagatatttttcatccggagctgttttccagtgtgaagtcttcgaataaggaagaagtgctcagtatgctctgcgaaaaatccactgcttatttccaggtagaaaatcttcattcccaggttttacagagggaagaaatcggcagtacctttttcagcaagcagatcgcagtgcctcatccgatgtatgcggtttcatccgatacgtttgtggcagtatgcgtatcgaaagaacctatcatttgggatgaagagaaaaatgaggttcacttggtgatgctgatgcacatcggaaaaaataatccgcaggcatttcagctttgggattatttctccaaaatgtttgccgataagtctctggtggaacgtctggtagaagatccgtcttatcctaattttatccggctggtaaaaggggctttggagacaggcatcaacagcacggagacaatttaagatcgtttaataaaatcagggcagaaattcatttttgggatttctgctctgattttatgttatagagagaaggccgggcagttttaaattaacccaatttcacgtttttccattgcaactgattggacttttttgtcggataaaatggatttagaatagaattaagctcaaggaggagaaaaatgaacaggagaagcaataagattctgaaggatctgatcctcggtattcatgcagacgtttccggattagaggagaaatatcatatacaggagagaacgatacgggcagatataaaagagctgaataaagatctggaagcatatgagctgccggtcattgcctcggatcttgacggaaagctgtggattgacacagataaaaaagttgatatccgggcctatgagaaatttatatccgagtacgacttttatacttattacctttcaaaaaaggaacgttccaccattctggcaatgattcttctgaatgctagcggatatgtgacggtggaccagctgaaagaaaagatcggcgtcagccgcaataccctgcttcaagatcttcagggattgaaaatctggtttaaagaaaatggaatgacgctggtatcccaggtaaggaggggatatattattgaggcatcggagctggatgtacggaaaggtatcttaaagcttttagaagtaaacggcgacgacaattattacaagaacggatatgatctgagtgttttttggaatcttctgttaaaagaggcagacagcctggaaatttacgagaagatgaaaaactgtattctggaagaagaggaagagacacagatattttttgccgactattctttttttgaggctgtgacagagcttacgattgtagccaaccggatcgtacgaaagcattttcttccggggtatttcaccaacgaatggaattatttaaaagaaggctccaagtacacgttcagcaaaggactgttcgggaaaatttctgacatgtttcagatggatgtgcgtgaggtcgaaatcctttactatacagaatgcctgaacggaaaaagttatttgaaagatgatgcacagaaaacaaatgctctggaattaagagtcatgatagcggaaacgatttatcagatttccagctgttttggaattgacttttatctggactttactctctatgacctgctggtggcccatatgaggtccgcggtgcaccgtctgaaaaacagcgaagttttggtgaatccgctgaaggatactttaatgcaggattatcctgagatttttgagagtgtgaagcagcatctcggctcactggaggattatgtgggccagaagttttcagaagacgaaatgtcctttatggtactgtattttgcctctgtgatggaaaaagaaaaggcagagacagaaaagagcaggaaagtaaaagtggctcttgtatgtgcaaccggaagagggactgcacaatttatgatggcgaaactgaagacgctggatgatatgatcgagatcgtaagtatctcttctttccataatatgagggagatcgagaaaaacggaacccagatgatcatatcaacgatcccgctggatgatgtgaacatcccttatgtggaagtccggtctcctatgctcgagaaggacgatatcctggatattcagagaaaggtcctggaaatacgggagggagacggtggagaaggtaaagaacgggagccggaaatcacaagtcctcctgatgtcaatattcagggtgcgttctatgatctgctgaatgagcagaggattcaggtgggatacgaggcaaaagattgggaagacgcggtccgtcagtcggggaatctgctgcattccacaggcgcagtggagcctggatacgtagatgaaatggttatgaatatcaaaagaaacggtccttatattgtcgtctgtccggaaacggcgctgccgcacgcaagcgcggaacagggcgtcattgaggaggcggcatcgatcctgagattaaaagaaccgattgattttcacagcggaaataatgatccggtgcggtatgtgatcgggatgagcattcagagtgcaaaaagtatcaacagcgcaatctatgacctgatgatgattttcgggaatgaacagatccgcagaatattagattctctgccggatgcagaagccgttttaaatacgatcaaacgattaaattcaaaatataatgaggagaaagacaatgaaaatgataaccagtaacacagacaaacattaccttgcagtttctttgtcaggttcagatgataaagaagttttggggaaaatggctgaggccatgtttcaggagggatatgtaacggaaggatttcatgatgccatcatccaacgggaggagaattttccgaccggacttccaaccggagagatcaatgtggccatcccgcatacagatcccgaatatgtaaaaaagccggccatctgtctgggcgtcctcgatcagccggtagaattttgcgtcatgggaatggagggtgagaaaaccagcgtatctcttttgtttatgctggcgatcaagaaaaaagaagaccagctggggctgctccaaaaacttatcgaggcgtgccaggatcaggaggttttaaaagttttaagaacaggcagtgtggataagatcgatgaagtcctgggtgacttaatagattagcacataaaaacgaacttattaatattttttatataaaggagaatatatcatgaaaaaaatcttaatcgcatgtggatcaggagtcgctacatcaacggttgcaaaccagaaaatttcagcttacctggatgagcacggatttgcggggaaatacaagatcgaacagtgccaggtttccgaagtcgttgagaaatccggaaatgttgatttctgtgtttctactactttagtaagcggtgatgtcaaatgtccggtgctggcaggacttcccctgctgaccggggtagggctggacaaactgtacgcttccattttggaagagatgcaaaagtaaaaacaggcagataaaaggaggattattatgcaggcaattattgatgtattcagctatattaactcactcggcgccagtgtcatgatgccgatcattttaacgatcataggtgtggttttaggtgccaaatttggcaaggcccttcgtggaggcctgacggtaggtatcgggtttatcggattgaatctggttacaggactgatgggcgaaaacctggctcccgcggtacagcagatggctcagagatttggattggccctctccaccgtggatatcggctggccggcagcatcagcgatcgcttttggtacgacaatcgggctgatcattattccgatcggtctgatcgttaatattgtcatgctgctgaccaacacgacacagaccctggacgtggatatatggaactactggcattttgcctttaccggttctctgatctatgttctgacaggaaattttgcttatggaattatcgcagcgattttaaatatggtgatcatcatggtaatcggtgactacacggcgccgaaagtagaggaaaccctgggcatgccgggagtgtcccttcctcatgggtttacagcggcatttgtgccgattgctatcgtcgtagacaagatcatcgacgttattccgggagtgaaaaatattaacatcgatattgaaaagcttcagaaacgttttggtgtattcggagaaccgatgctggttggaactgttttgggaatcatcattgcagctttggcaggaaataatgtacagacggtactgcagattggtgtcaccctcggtgctgtcatggtattgatccccaaaatggcagcattgttaatggaaggcctcatgccgatttctgatgcggcccaggaatttgtatcttctaagtttgcgaacagaggaaaaatttacatcggactggattcagccgtaggtgttgggcatccggtatgtttaacagtatccctgatcctggttccattggcagtctttttggcagtgatccttcctggaaatactgtgcttccgatgactgacttatctgtactgccatatatgtttgttctgatcgtgccgctggtaggaggaaacggcttccgggcactgatcacaggaatcgtctgcctggttggaggactttatatttctaccaatctggcaccatctatcaccgcggttgcaaaatccgtaaactttgcaatccctaagggagccgctacgatttcttctatctgtgacggggcaaacccattgtcatgggtacttgtaaaggcacattctgtgggagcagtcggactcatcattgcggtagcagttgcagttggattagctctgatgaacagaaaacgcattatcaaagaagcaaaagaattacatgctgaggcataaagaaaggtaaaaaatgatgaagcgctatgtatatcaaccatcacatttttctatacaaatgacggcacccgggatttttactgcggccatcggagtgttctgcctttatcagtttttggccgcaggacatcatctgctgtatttactggtttttggactgtgtctctataatgtctttaatgtatttgtgtcactcagcaatccgtctgaagtccgcattgacagcgggaagaccgtagtgttctgtgcttacgggaggagacatacatatgagatcagtcagatcagcaagtacagcatgaggccgctggcaggaggaacaaaaatgtatatgacctttgacggcggcgggatcatgaggggaagatactgggtaagaatttccgaattttctgatgaaaaggagctggaagaattcttttatgatctggatgcacagatcaacccggactctctggtctcaaaagcaagaacccagggacgggaacggttaaaaaaaacgggaggatgtaaatgttagtttcattaaaagaattacttgaccaggcaaaaatagaaaagaaagcagtcggcgcatttaacggaaccacactggaagcaatccgggggattattcaggcggcagaggagctggaatgcccggtgatcctgcagcatgcccagagtcatgacgaattgatcgatcttgacgagatcggaccaatccttaaatattatgcaaaacgggccaaagtgccggttgcgcttcatctggatcacggaagcagctttgaacgctgtgtccaggcacttcatctcggatttacttccgtcatgtatgatgcttctgcaaaaagttttgaagacaatgtaaaagaaacagcagagatcgttaaaattgcccatgcagtcggcgccggcgtggaagctgaattagggcatatctttacttcccaggttgttcagggagaaggagccggatctgacggcaaagatgattatgatgatttagattccatttatacagatcctgaggttgcaggggaatttgtggggaagactggagtcgactgcctggctgtggcattcggaacgacccatggggtgtatctgaccgaacctaagctggatcttccccgggttgcaaaaatccgtgatgcggccggagtgcctcttgtaatgcacggaggctccggtgtgtcagatgaagattacaaggtggccatcgaaaatggtatctgtaaggtaaactattatacttacatgaatacggccgggggaagggcttcaaaagaatactgggaagatgaagcaaaaccgctgttttatgattccatgtccctggcagccacagaggcagtcaaagaggatgtaaaaaaagcgctgaaagtattccagaagaaatgatttggagggaaagaaagaatggcagtatataaagatacgatcaaagtacagtcacatggcaaaacacctacctatattgatgtgactccggaagtaaaaagggtgattaaagaaagcgggattaaaagcggactctgtgcggtcatttctccacatacgacctgttctgtgttttttgaggaatttgtccacgactacaatgagaatggggatgagtttttacaggaagacttaaacaatgctttagcaaagatcattccggatcatgtgagcgcggatcaataccattatccgggagaagaacactataaagaagtggaaacctggccggatttggatttctggcttccgggaggagacagaaccgcattattcaacggagatgcacatttgagatctacgattctcgggtccagcgagatctttgatgtggaggacggcaaattaggagtcggtgttacaggatatgtttattttgtagactttgaccgcacgcgtccccgggaaagaaaatgtaaaatagttgtcattggagagtaaggaggagaacatgggaaatatgcagtcaccgtttttgattgtaaatccaaagtcatatttatacggaaacgagagtcttaaattggcgaaggccgcagatcaggcggctaaagataccggactgccgattatctttacttgtccatatgcagatgtgagaatgatccgtgagaatacggaaaacatcattgtatgcgtacagtctatggacccgctcacaccaggacggggaatggggcatgttcttccggaatctttaaaggaagcaggagcggatgcagtttttctgaaccatgccgaaaatcctaagacgctgtctgacctatatgcatgtatccggcgcgcagccgagcttgacatgacttctatcgtatgtgcggactccattacggaagcaaaagccgtggcgtgtatgaacccggatgttgtcctggcggaaccgacggatctgatcggaaccggtcaggtagcagacgatgcttatacaatggaagcaatcgatcaggtacgaaaagtaaatcctgatgtgctggtggtggttgcctccggagtcagcacggcagaggactgttacaatatgattcggcttggagccgacggcacgggaggaacgtcagggattttaaatgcgccttcaccggctgtcaggatcagggagatggcagaagcgatcgtgagagcagtgaaagcttctgattagatgaaataaattttaggaatacccataatttctgcgggcagaaattatgggttttttgtgcaaaggaaagaataaataatgagaaaatagaaaaatatagtatgagttatttactactatttccgtcgcgcttttgaaatgcgctcctccaaaagtgataaataactttcgaaaagtggcaccttttttggcagaaacccttctctaacagacattacgtccattttccacatgattggagtgaggcattctaagagccgaacggaaatcatgtggaaaatgtcatgatagattctacaggaggaatgcctgatggaacgaggattcaggaccggaatattaatacaataccatttacacgaagaaatccggttttggcagatgtattccaccgattaggatatatggagcgtcagggaagcggactgaataaaataacgagtgcttataaaagtgcgataaactttcgagaaggattggaaccaaaatttttttctgacagggtggagtttactgttacactgcaaaacctgaactataaaagtgaagctaaaagtgaagctaaaagtgaagctaaaagtgaagctaaaattttggaattgacagatttagagcgaaagttatgcaaatatcttcaaaaaaatccagagattacccagatggaaataaaagaaaaatttggattatccagaagcaaggtgcagaggataaccaaaaaattaatagataaaggatttattgttcgtgaagggtcacggcgaaaaggaaagtggaaagtcttttaaacgaaaagggacacgatcagtcttatgacaatcgtgcccctttttgttaatcactgtttattcgttgataatcgtcaccagctctgctgcctttctacttacattttctatggactgaatgctaagtccgataacattcacttcgttatggttctgttcatacgcttctccaaaggtagaaataaaagcctttcttaaatcagatccgtaatttactttcaacaagttaaactctcttgccttctgaatcgtttcaaacggaatcccggaaccgccatgcattacgagcggtacgggggaaacctttgagatctcatctaataacggaagatctacttttggagtcagatccagaccgtgaacgtttcccacggaaaccgcaagcagatcgcagccggttctttccacaaagtcagcgaccatttccggatctgttttgctgtccgcttcatttacaatatcctcttcttttccctgcagcgcaccaagctctgcctctaccggaacaccataaaagtggcagtattctactgcgcgtttcacttctttaatattttcttcaaacggaagatgggaggcatcgatcataatagaagtaaagcctgcatccacacatgcctttacgtgttcataagactttccgtgatccagatgaagaccaatcggcacatcactgtctttcagtgcatcttttgccagataagtgatcgtgtccgggcttgagagccgcagattattggaagatatttggatatatcccggaagtcctgcctgatttaatcctttggcgatggcataagtcatttccaggttggttgtattgaacgcaggcagaatataatggttgtcttttgcatatttcatcaggtcaaagccgtttacaattttcattttcatatagcggcatatacaaaaagccgcttcctcctatctaatctgaaattttcatttttaccgttcaccagtacgtactaagcttgattcgattataacaatgaaaataccttgaataatttaatttattgcgcaaagtatcccgcaaaataagtgcagaatgaaaggaggatctgcgtaataaattgcgcagtcaatcatgcaaaatgctgtcaggtactgcggtattgattgtgcaaacatttgtgaaaaacagcagagtcggcatgatatacttcaattacatcgaaggccagatgaaaaggaggtaagggaatgaaggtcattgcagtatcccacggaagctattcaaaagggctggtggagagtacccaaatgcttgtcggagaacaggaaaacctggtggcgtatggactgtttccggaacagacggtggcaacactgacagaaaaactggaagcggaaattcaaaatacgaaagaaggggaagaaatactcttcgtatcggatctgttccacggaagcccgtttaatgcgatagtttctttgatggaacaccatgacatttaccatgtaacaggaattaatcttccgttaatggtagaagtgatgatgggacgttatgctgggaaaagcgcagaagagatttgcgcagggcttcttgaagcagcgccgggaacagtaaaagatgtaagaaagctatttgaggaggtagacgaggaatgaaaaatgttgtattagccagagtcgatgaccggctgatccatggggaagttgtctcagtgtggactccgagcttaaatgtcaacaggatcatcgtagtcgatgatgaagttgcggcagataagttcaacaaacgagtgatcaaggcacttgctccaaatggtgtaaaagtaaatgtatacggaacagaaaagggagcagaggttcttaagaaagacccgaaagaagcgggagagagagtcatgatcctcacgaaaactcctatcacttatgaccgtatgacagatttaggactcgaactgaccgatgtgaatctgggaggaatgggacttagaggagagaggacaccatttattaaaaatgtagcctgtgatccggatgaaattgcttcgattaaaaatttgatggcgaagaatgttcatgtttattatcagctggtaccggaacagcaggtgattgaagttactggatacttggataaatagaaggaggaagtatatatggaaaagatgaccatcatacaggcagccttatgcggggttgtttactggctggcagttggaaacctgccgtttgtaggcctttggtctttacagagaccgctggtctgcggtatgattaccggtttgattctgggtcatccggtacagggagccgtgatcggagcaaccatcaacttagtttaccttgggtttatgtctgcaggaggaagtatgccggctgatatgggactggcaggagtcctgggaacagcctatgcgattgtcggcggattggacaccgataccgctctggcactggcagttccgatcggtattctcggaacgatcgtctgggcaggacgtatgacctttgactgcttctttgtacatattgcagataagtatatagaaaaagaacagtataacaaaatctggcgggcaaatgtcttatttccacagattatgtgctttcttatgacggcaatcccgtgtgctcttgctgcatattttggttctaactatatccagggaatcctgaatatgttaagcggaaaagtgctgaccgtcttccaaatcataggtggtttaatgcctgcactcggaattgcaatcacactgcagtacatctttaaaggagaatccaaagtatttttgtttgtaggatttttattggctgtgtattcaaaacttccgctgctgacactgggtattatcgcactgcttgtggcagttgtgtacgttcaggttacttccgctatggagccggcgaaggcagcagtcattgacgatgaagatgatgaggaggacgattaagatggaaaataaaaagaaaagtttgatcccaaaggccgccttgatcaaagcctggttcatttgggagacatttccccagacgtgttataactacgaaagaatgatggggcaggttgttgcccatatgttctcagcgattattaatttcttatataaagataacccggcaaagcgaaaagaggtcatgaaacgggaaattgaattcttcaatgtacatattgaattcggcgcatgtatcctcggtatggcggttgccctggaagaacagaaggccatgggtgaagaaatacccgacgagtttattacgaacttaaagacttctttgatgggacctttagccggtatgggtgatacgatctggcagggcgttgtgattccgatcctcttagctgtgtgtattgacttaacccgttccggaagcggaaatatatggggagccattatttacgcggttgtcatcattgcagcggcatatggcctcagctactggaactttatgttcggatataaagccggaagtgaagcgatcatggacttccttgaaaagggaattcttaataagctgatcaaaggtgcttctatcatgggctgcatggtaatgggcggtcttgttgtaaattatgtaaaagcaagctgcggactgaaagtggtaagttctacatcaacttatgacattcagacaagcttcttagacgcgatctgtccaagtatccttccgcttgcagtgaccatgcttgtttactatctgatgaacaagagaagatggtcttccctgaaaatcatcgggctgatcgttgtgatcggtgtggtaggcggagtgacaggaatcctggcatattaagttcagaaagagtgagatagatgaaagcaatcgtattaaatcaaccaaaaaattttgctgtcaaagagattgaattaccagagttaaaagaagacgaggtgctgatccggatcaaagattccggaatctgcaccaacgatgtacgggacttcaacggagactgcagttacagctacccgaggatcggcggtcatgagtactgcggagtaatcgaggaactgggaagcggagtcaatgaaaaacgttactccaaaggacagaaagtggtccagtatatcattgatgactgtaaggaatgttttttctgcaagcacggagaagaaaatatctgtgaagaacatccaaagagtaagatttttacgaatcccgacgggctgtcaggatatgggggatttgcggaattcgttgtggcaaaggcggaagatctgtttgtatatccggacagtacaacttttgaaaaaatggcatttaccgagccactggcatgtgtggtcaacagtatcaaccgtacgaatattcagtttggagacgatgtggcagtcatcggaggcggtaccatggggatgcttcacgtcatgcttgccagattaaagggagccagagtgattttaagtgagcctcttagggagcgaagagacagggcgctgaaactcggatgtgacgatgtgatcgatccgacgaaggaagatgccgtaaagagagtaaaagaattaaccggcggcagaggtgcgcaggtggtattcaatacgacagcgatcccggccattgcggcacaggctgtggaaatgacttcccccggaggaatgagcgtcatgttcagctccatgcatcccaatgatccggtgccgatagatatgggggctgttcattcttaccagaaaacggtgacaggcgctgtcagcccaacgattacatcttttcatcaggcagtgcagctgatcggaaaggggctgattgatccaaccgtgcttacagaacagatttttgattacagagattttgacaaagccattgcggcggcaatgaagccggatacttataaagtaatactcagatttggagaatagcgaatggaacagtatattggaattgatatagggacttcttctgcaaaactgaccttgattaattacgcaggagagatcagaaaagaaagcagcagggaatatgagatttctcagccggcaccaggatggaaggaaattgatccggaaagctggatggatgcggtggaagaagccatggcggaacttctttcaggagaagatccggagcacatcggagccattggtgtcacgggacagatgcataccgcagtatttctcggatgggacggatcgcctatacgtccggcattgatgtggaatgacacaaggaccatggatcttgtaaaggaaacaaaagaaaagatctctaaggtcccggaagtttcctatatctccaatatcatttccaccggaagtccggcgatcaatctgctgtggctgaagaaaaatgaaccggaacaatttcggaagatgaaaacatttttgattggaccggactatatcgtttttcggctgacggggcagtaccagactgactactgcgaggcatccacttcttctttgtttgatttaaagactggaacgtggtcttcaaagatccgggaaatcttagggtttccggaggagatttatccaaaggtaaaaggaagccaggagacggcgggatatgtggccgaagtatggaggcggaagttcggtttcaaaaaccaggtgaaggttatcgtgggtaccggggataacccggcggcagccatatccacagggtgtttttcaaacaggtatccggttctttccctcggtacatccggtgttctcatgtttccaaaagaaaaaatggatttcgggacaaaaggaaagaatattatgttttctgcagacggaaagaacatcatgacgctggtacagggtgtggtacagtcaacgggaagcagctttggctggtgggtcagacagatcttaaagacagatgatttttctgccgaaaccagcgaagtggacatggaaagtctcggggaaaacaatctgatcttttatccccatcttgcaggtgacaagacgatctacggagatcctgcactgaggggagctttgatcggtatcggaactgaaactacaagacaggatatcacggctgcggtcatggaagggatctgcttcggtgtgagacagcttacagaagtcatgcacattgggaagacagcacttcaaagtcttaaagtgaccggcggaggctctaaaaatgaagtatggatgcagatccttgcggatgtgctgaatacgaaagtagaacagctggaaagcggggcaggagcgggatacggcattgcgctcatggcagcatcagtttcagggcgggatgtaacactggagcagatggttggcagaaccgtccgcacaaaaaaatgttttaatccaagaagatatcatgcagagctttatgaaataaaataccaaaagtataaaaaagtttataaagcgctgacagatgtgtttggtgatcagaaagggtgaattggaaatgaagacatgtgatatctgtgatgcacctttgggaatgtttaagaaatttcgatatgcggaaggatacatctgcaaagcgtgctatgagaaggccagcaatcattttacagagacgattgcaaagaaaagttatggtgagatcagaaaattgtgtgaaaggcagggcgggctcacagaagattttgagattacagggcggatagggaattatattttgtttgatgagaaaaacaggaagatctgccttctcaacaaccggattaaccaaaaacaggtttcagagccggaattttatccgctgaataagatcagcgagtgccggatcgattacagacctttcatgcctttgggagaactggaagataaaattaagtcaaaagaagcaggcacgattcactctctgaaagttctgatcaaactggaggacggccaggaaaaacaaattcctttgatatcaaatcctgtcaggataaaaagctttgctatgaaacagtccttttcatttgcaaaacggattgcggaagaaatcgaaaggctgaaaggtgaatctgtccaggcatgatcagggaggaaaaagatgaagcagtttgattttaaagtgcagtcgcctgttggaatccatgcgcgtccggctgtgcttctggtagaaaaagcgcggacgtaccagagtaaaataattctggaaaagggaactcagagagcgaacgccaaaaatatgatttctcttttgacactgagagctcgtcagcatgaaatcgtaacgtttatgattgaaggaccggatgaagacagggcggcagaggaattgaaagagttttgtattcataatctttaataatacagcatctttatcaacggaaccggcagcgttgataagggtgctgttttgtatccatgagtatagaaatgaagcagaaagaataataaaaagtattccatggggacataatcaacggattatgtgtaaaggcagggaacagtgactatctgcatactgagtgactggctgtttataccagaaaacccctttaaatacttgataacagttgatcaaagtggtatatttaatcttagtatggaatcatatcagttgggaaaattcccttgctaaggaggaaaaggatggacaacctcgcaaaagagattgaagagttaaagagagaacgaaatgcggtcttattggcccattattatgtagatgacgctgtacaggagattgcagactatgttggggattcgtattacctcgcaaaggtagcgcttaaggagtcgaaagatgtgatctgttttgccggtgtaagctttatgggagaaagcgcgaagatcctgaatcccgacagaactgtgatcatgccggaccagctggcggactgcccgatggcccatatggtggatttggacaagatacagaaggtaagggatgaatatgatgatctggcagtggtctgttatattaattccacagcagagatcaaatcctattccgatgtctgtgtgacatcatccaatgctatgaagattgtaaaatctcttccacagaagaatatattctttattccggatgagaatcttggcagatatatcggatcaaaacttcctgagaagaactttatttacaacgacggattctgtcatgtacatacaagtattactgcagacaacgtaaaaaaagccaaagaagcgcatccggacgcagagatccttgtgcatccggagtgtacgatggatgtggtggaactggccgactatgtgggaagcacatcagggatcatagattatgccactgcatccgatgcggataagtttattatctgtacagagatgggtgttttatatgaactgaaacagaagaatccgaacaagacgttttattctgtggggcacagacagttctgtccgaacatgaagaggatcactcttgaaaatgtcagagatacactgagagacatgaaaaaccaggtggaactggatgagacactgcgtcttgacgcaaagaaagcgttggatgagatgctgcgaatcgcacagtagatattaacagcctcttatccgggggaaaggattaattttaattatgagatcagcagatgtaattgtggttggaaccggggcagccggattgtttcacgccttgtttcttccaagagattacagagtcattatgattaccaagacagaagtagaggagagtgattccttcctggctcagggaggaatttctgcactgcgcaatgaagaagattacgaccgctactttgaagataccatgaaggccggccattatgagaacgacaaagcggctgtagacaagatgatcacccgttccagggaaattatcgatgaccttatcggattcggtgttcagtttgatcagagagatggagagacagaatatacccgggaagggggacactccattttccggattcttcatcacgatgatgtgacagggaaagaaatcaccggcaagctctatgaggaagtgaaacggagggataacattgagatcctgacccattctacaatgatcgatctgatcgaggaaaaaggagcctgccggggagttgtctatgtgacacccaaaggagatgtggactgtatttatgcagggaagactgtactcgcaacgggaggcatgggaggtctgtttaaacactccaccaattacaggcatctcaccgcagacggattggctatctgccttcgccataacgtggagatacagaatatcaattacatacagatacatccgacgactttttattcggacaagccgggaaggagttttttgatttcagagtctgtcagaggagaaggagcctatttattcaataaagacggggaacggtttgtagatgaactgctgcccagggatattgtgacagcagctatacgtgaacagatggagaaagacggaaccgattatgtgcggctgtctgtgactcatctggacggggatcggatcagaaaaagatttcctaatatttataagcagtgtctggaagagggatatgacatgacgaaggaatggattccggtgactcccgcacagcattattttatgggagggattaaggtagatttaagcagtcgtacttccatggaggatttatacgcagtgggagaggccagctgcaacggagtacatggaaagaaccggctggccagcaattctcttctggaatctcttgtttttgccctggagtctgcagaagatattgcaaagtcgccgaaaaaaccttcagagtgtcaggttgatttagcacagtatcatgacatttccggtatacaggaggaaaacaaacaccttgtactggaagagatcaaaagaaaggatggggatttctatgataaatggtgtaacaatggcggtaaacattgatgagtatctgctgaacgcattaaaagaggacatcaccggagaggacgtcagcaccaacgctgtcatgccaaaaccgagacagggacaggtcgaactgatctgtaaagaagacgggattgtcgcgggtttggaagtgttccaccgtgtgtttaccctgctggatgaaaatgtaacctttgagacagagctgagcgacggagacgaaatcaaagccggacagcttatgggagttctcaggggagatatccgtgtcctgctgtcaggggagaggacggcccttaactaccttcagagaatgagcgggatcgcaacatttaccaattcccttgtaaaagaattagaaggttcctccacgcagcttctggatacgagaaagacaacaccgaatatgcgtccgtttgagaaatatgcggtaacagtcggaggcggcaagaatcaccgctacaacctttccgacggggtgatgctgaaagacaatcatatcggtgcagccggaggagtccgggaggcagtctatgcggcaagagcctatgctccttttgtgcggaagattgaggtggagactgaaaatcttgccatggtaaatgacgctctggaggcaggtgcggatattattatgctggataatatgtcagatgaaatgatgaaagaggcggttgaaattatcggaagccgtgctctcaccgagtgttccggcaacgtgacgaaggaacggttaaaaaagatcagggagatcggagtggatttcgtatcttccggggctttgacccattcggctccaatcctggatatttcactgaaaaacctgaaaccgacagaataacagaaaagtgatatgggaaggccagaaaatacaggatattttctggcctttttcagcgccttttactgatagtggaagggatgtctttaagtgagcgttgacagaaatcataggaaagtctaaaataataataaataatatatatcaataaataataataaaaggagttcctatgctttccaagactgcatcaaaaataatgagagtgctgattcatcaggatgatgaatttatcacctatgaaagaattgcagggatgctggagatttccgagcggagtgtacacaattatatgaaagaggcagctgaattctgtgaagaatatggatatcggcttgtccgccggaggggaaagggggtctgtcttcaggcaggactgcacagaaaagaattggaacacttatttccgaaagaccagatcccctgtgaaacaagaaaataccggatgtgctatattatcaggactctgattgaaaatggggagccttacaccggatctttgtttgccgaggagctgtttgtttccaaatccacgatctgtacagatatcgagaaggcaaataagatgttagagccggacagggtatgcattcggcggatcgttggaaaaggaattattatacagggccgggaatttgacctgagaaaagttctggtgtgccaaaaccagaaagtatatctggaagaagttccaaagtcagccgcagtgccggattacagaatcgatccggtgacatatgcaagatttttatctcagtacagaaagagcacagctgataaggtgattgcctgtattcagcagctggagagacagatcggcacgcagtttaatgattatacattttgtatgctggctgaatatacgagcagtcagatgaaccggctgagaggagggcattgtctggaggagtctatgatcagcagactgacactggtagaggagatcgccgactggacagatatattcacgggacttctgaacaggcaattcaggatgaacattgatccgagggagggattgtatttgtatcttctgcttcttggagcggaagtacagaacagcagccgcatagtaaacaaaaaatttctgatcgaaaaggagatcgatatcgaggacgctgcccagaacatgattcagtatatttcttccatcgtgggcagagatttcagggaagatcctctgctgaagacgagtacagccctatttctgaacagttctttcataagagttaagtttgggtttgagattaaaaatccttttttggatgagataaagaggacatactcagccatattttcagcttgttttacggcaagcaaagagtatgaaagccttgtgggcgcatttccgacagaagatgagatctcctatatggcaattctttttggcggcgctatggttcagaataagagggacattaatacagttgttatcggcagcggcggtgtggggatcgctcagatcattgccagaaagatcgaacataagattatggacatcaatgtcacatcggtactccccgcaaatgcaggagtcatgatcgatgagagccagtatgaccttgtgattaccacggtcccctcactgaagattaaacacccttatgtggtttatacgactccgcttgtgggagaacaggatgtcttcaggatcaagaaagtttgtcatgagatgaaagaaaagaagaagaatctggaaaaacggtggactattaaaaacttgatggaggacgaactgatctttctggagtcagggacaatgacgaaaaaggctctgttacataaggtgtgcagaaagctgaaggacgggggctatgtaaaggatggattttatgaggatgtactgaggagagaagagatcagcgcatctgtgctcggaggaggcgttgcagttccccatggcatggcaaatctcgttgaaaagccggctgtggcaattataaagacggaccacaaagttgagtgggatgagggaagcgtggatgtaatatttttgctggcgctgaattttgaagatattcagtccaccagagccttttttgaaacattttatgaaatgactatggaaaagaatgcggcaaaactcataaggaaagcaggcagcaaagaagagatcaaaaatattatcatgatgaattcggattaagaaggtgtcttttgggcactttctttttttatttcattaggaaagttctgcggccttccctatgaaataaaaaatgctccgcgggctgtacacagatgtgtgaggaaattatttgactgctatgtcataaactgcagttgtttacctgcaatttttggttttgaatcggtgcagtgctgcgtttttgcagatatacaactgcaaaaagagaacgaaagagacattgaataataagataaataaatataaaataataataaacaaagacaaataataaaaaggaaaggaaagcgatgaaaaaagcagcggaaaaagaactcatggtttctgcatctgtttcctgcatggatctgtgtcatttggcagatgccatagaggaagccgagggatcgggaatctcgttttttcactatgatatggtggatggaaggtttaatgattgtttcatattatcggaaacactcttaaaacagatgagaggcataaccagcctcccaatagaagcccatctggccgcttttgagccggagcgctatatcggcatgtatgccgatgcgggagcggattacatagcggtacactatgaggcgatgaaagatcctctcagggtgtttgaacagatcagggaagcgggtgcccggccggtattggcatataaatccacgacacctccgggggaggatttcatcacactggcaggtgaggcggcctggatcttaaaactcacagtcaaccccggattttcaggacaaaagatgcaggagggggcgctcggccacatcaggcagatgagggcgatgctgaacagcgcaggactgaagacgaagattcaggcagacggaaacatcaatcaggatacaattccgagggcggtggaagccggagcggacatcctgaccgggggaacatcgggattgtttcttgacggaaagacagtaaaacagtgctgtgaagacatgctaaaagcagcagaagaagcaaaaggagcaaagaaccatggaattaatgaatgaagggctggtcgtatttgacctggaagcggcatcaccggaagaaacagtctctaagattgccggagtaatggaagaacagggtcgtttgaatgacagggcggcatatgtggcggatgtgataaagagagaggagggagcaccgacaagcataggatttctgatcgccacgccccatgccaaatcagttcatgtaaaggaaccgtcgctggcatttgcaaggctgaaagacccggtgcagtgggcggatgaaaaagtgcagatggtctttcagatcgcagttccggacccgggacagggagataagcatctggagattctggcgaaactgtcaagaaagattattcatgacgacttcagagagcagctcatgaacgcagccaatgaaaaagaagtgttggaactgatacaataaggaggagagagaagatgaacgaacttgcaggtattttcaaagatacaagaaaacatctgatgaacggagtgtcccatatgatcccgtttgtagtgaccggaggtattttaatggcagttgccgtcatggcatacggacagggaggtgttccgccggaggggacctggatggcaactttatggaactttggttctaccgcgctgaatttgatggtaccggttctgtcggcatatattgcggcatccatcgcagaccgtgcgggtatctgtcccggatttgtcggaggaatgatctccatcagtgttggagccggattcctgggaggaatcgtaacagggcttcttggcggaattgtatgctattatttgaaaaaggtcaaagtgccgaaagcattgagttccatcatgcccatcatgatcattccgatcgtcggttctttagtaaccatgggatttatgcagtatgttcttggagctccgatcgcaggaattatggacggaatgacaaaagttatggagcatttgggaaatgggaacaaagtaattttaggcgcagtatgcggactgcttgcaggatttgactttggaggaccgtttaacaaggtagcatatacattcggtgtggctacagtaagtgccggtgtgtatacatatgcagggcctatggcagtgaccatgacagcaccgcctctcggatgtgctctggcagcatttttggcaaagaaaaagtttacccaggaagaaagagaagcagcaaagagtgcggttgctatggggtgtgtagggattacggagggagcgattccgtttgcagccaatgacccgctgcgtgtgattccatcaaccatgatcggtgcggctgcaggcggagccgtgggctatctgtttaatattacaaatcctgttgcctggtccggcctgattatgattcctgtccttggaaatccgattggatttcttgtgtcccttgccattgccgtcggcgtaactgcggggctgatgatcctgctgaaaaaggacattacagaagaggcagccggcacagacgaaggggatttagacattgatctttccttcgaataaataacagcagaaaaccaataggaggtattttatcatgaaatttttagcggttacggcgtgcccgtcaggggtggcacatacctatatgtcagcggaggcgctggaaaaggcagcaaaaaagcacggaattgagattaaagtagagactcaggggtccatcgggatagagaatcagatcacaccggaggatctggccggaacggatgcggtgatcctcacaaaagatatgccaataaaagatgaagaaaggtttcagaatatcccgaaggtccgggtgggagtcagcgacgctgtaaagaaagcagaggcgattattacaaagttggaaaagatggtgaaggaactttaaaagaaaacaggggcggcttaaaaaagccgctcttttctgattatgtattgaaaaacaataaaaaataatatataataatataaaacaataaacaaaaaacagggaaggagcagtatatggagggtgtttttcagacagaccgaataaaatacttaaaagataaaatgttatcagaaccaaggtatgcttccattgagcaggcgctcattataacggacagctacaaacaacatgaggatcagccgaggatcattcagagagcactggctttaaaagcatcattggagaagatcaagatcagtgcagaaccggaggaactgattgtgggcaaccgtacggcaggagtccgttatggggttgtctttccggaaagcggaagcacttgggtggatcaggagtttgagactcttcccacaaggccgcaggataagtttcatgtccatccggaggatattgaaacattcagaaaaaagattaaaccctactgggaaggaaagtctctggaagatgtcctcaatgagagttatggaaaagaaataaatgaaatatcgaaagtagtaaagataaaccaaaaggaccatgctcaggggcatatctgccccaactgcgtgacatggctgaagctcggtccggcaggacttcagaaacaggcaagggagaaactgaactcctgcagtgaggaacagaaaaatttctatgaaagtgtcattctggtgatggaaggcgtcagaagctttatgctgcgctatcatgacctgatgatgggactctcggaagaacaggacgatgaagccaagaaggaatctatgatccgtgtggcaaaaaactgcaaaaaactgagccagcatccggcagagacttttcatgaagcggtacagtctgtatggtttttgttcgttgtcctccagatggaatccaacgcttcttcattttcaccgggtcgtctggaccgccacctgatctcttactatgaaaatgacataaaagaagaaagaattacaaaacaggatgcactggagatcatcgaatgtatgtggctaaaattcaatgagatcgtttatatgagaaattcccacggtgcgaaatatttcgcaggatttccgatcggattcaatatagctgtcggtggtcaggatgagcatggaaatgattattccaatgatctttcgttcttatttctggaggcccagaaacatcttggacttcctcagccgaatctttctgtcaggctccacgaaggcacaggggatgatcttctctttgaagcggtccgtgtcgtgtcaaagggcagcggaatgccacagttttttaatgacaaagcagtgattccgtccgtcatggagctgggaattgaagaaaaagatgccatggattatgccattgttggatgcgtggagctgaccacccagggaaacaatctcggatggagcgattctgctatgtttaatctgaataaggcactggaagccgcaatgaccggcggaatctgtctgcttacaggagagaagattgcccctgattacggaagccttgagacttatgagacgtttgaggaactggaagaggcattccaaaaacagattgattacttcatggacaaaatgattctggcctgtgaggaagtagagaaggcacacattgacctgctgccgtctccgtttctctcagcgtccatagacgactgtatggaaaaaggaatggatgtgacggcggggggagcaaaatacaacctatccggtatccagatgatccaggttgcaaatcttgcagacagcctggcggcagtaaaacagatggtctatgatgataagaaaattgagccggagagactgcttcatgcattaaagacaaattttgaagaagatgaggtcttgaggaccatgctcttaaataaagtgcctaagtatggaaatgacgtggactgggtggatgccatgggtactaaatgggctgaatactttaaaaaccggcttcgcacatttaaaaactaccgcggaggaccataccacacgggaatgtatacggtctcagcccatgtacccatgggagaaaatgtcggggcatcaccggacggacgttatgcaggagagcctctcgccgacgggggaatgtctccggtctacggaagagatatgaaagggcccacagcagttctgaaatccgtttcaaaattggataaaaatcttacgacaaacggcgggctgctgaatatgaaatttctgccggaattctttaaaaatgaatccagtatccgcaaatttgcgggatttctgcgaagctttgtagatctggaaatcccacatatacagtttaatgttgtacggagagaggatctcatagcggcaaagaaaaatccggagcagtacagaggtcttacggtccgggtggccgggtataccgcatatttcacagaactggcggatgaactgcagaatgagatcatcgcccgtaccagctatggagatatttgatatgaaaggaacgatctttgatattcgcagattttccacccatgacggggacggcatacgaacgacagtctttttcaaaggctgtcccctgtcctgtgtgtggtgccagaacccggaggggatttcaccgaggcggcgtccgctgtattttgagaaccgatgcatacactgtaaaatctgtgcggcagaaagtgtcagcggaggaatgaagtgccgtggagatacgatgttcatgaatattgatgcgccggaagactgggaacatctgattgaactgtgtccgtcaggtgctctcgcgatggattccagagagtacagtgtgaaagaagtgatggaggagatcagaaaagacacggtattttacaggcatgacggcggagtcactctgtctgggggagagccgctgcaccaatcggaatttgcactggaaatactgaagcagtgcaaaaaggaaggaatccatactgccatagagacttctctgtacgcagaacaggaagtactaagaaaacttctgccgtatctggatttgatctatgcagattttaaaatagcggatgaggaaagacacaaaaagtatgtgggagtgccaaaccaaaagatcaaagaaaatataaagtatctgctggaatccgaaaaaagggaccaggttatcataaggactccgatgattccgggccttaccgcttacagagaaaatattaccgaaattgccgtatatatcagcgggacagatcccgatgtctcgtatgaaattttaaactataaccccctggcggaagccaaatatcatttgattggcaaagagttctgttttgccgaaaatccgaagatgtattccaaatcacagatgaaagaattcgagagctgggcaaggcagggcggtgtaagtaatgtgatcatggaaatttaaattaaggagaataagatgaaatttattattgatgatgcaaatgtggaagctattaaaaacttatatgagtattttcctgtggaaggggtaaccaccaacccgtccatcttagccaagagcaaacggtctccttatgaggtgctcggtgaaattcgtgagtttattgggaaggatgctgatttacatgtacaggtagtatcaaaatgtgccgaagatatggtcacagaagccgaagaaatgctgaaaagacttggagagaatacatatattaaagttcccactacaagggaaggattaaaggcaatgaaacttctgtcttccaaaggggtgaagataacggctacggccatctatactccgatgcaggcgttcttagcggcaaaggcaggcgcctcttatgcagcgccgtatgtaaaccgtatcgataatctgggggccgatggaattgagacggtgaagaagattcacgatatttttcaaaacaacgggcttaaaaccgaagtgctggctgcaagttttaagaattcacagcaggtactggaactctgtgcctatgggatcggtgctgcaaccatcgcaccggatgtcatagagggactgatcaaaaacgatgctgtaaccgctgcagtaggcgcgtttacaaaggactttgaaggattgtgcggcgaaggaaagaccatgaaggactgttagatataaaaaagaaaccggagcagaaatcgcttcggtttctttttgaaatattacactgtgataacacccattccctgtagtatggagaacaggagaatggcaatgatacaaatcggtgcaaaaaatttaatcattggaatatataaatttttacgtttgaaatctcctgaactttctacttcatcaatgatctcttttggcttgatcacataagcggcaaacatgcaggtgcagaatgctgcaatcggcatcaggacactgttgctcaggaagtcaaagaaatccagaaaactgaagccaagaagcttgatatgactccatatgccaaatcccagagatgacggcactgccatgatcattgcaatgacaaacatggtaatgcaggctctgatccgggataaatgaaacttatccattacgatggagaccagcgtttctaaaagagaaatcgcagaagtcagcgccgcgaagaaaactaaaatgaagaagacagctccgataacagttcccagggccatgctgttaaaaacttttggaagcattttaaacatcagggatggtccggatgcaagcatatccgcatttcctccggaaaatacaaagactgcaggaacaatcataagcccggacaggaatgcaacacccgtatcaaatatctctacctgtgaaacagacttctcaaggttagacttcttcggcatataggaaccaaatgtgatcatgattcccatagcaagggacatggaatagaacagctgtcccagagcagccaggaatgtggtaggtgtcagatccttgagatttggcttaatgtaatacagtacaccttccatggctccctttctggtaatgcagtaaacggagattccgatcagcaatacaattaagatgggcatcaggatcgtactgactttctcaataccgccttcaaccccgagagctacgacgatcagtacaagtcctgcaaagatcagaagccatatcatagggcttacagactggctgataaagccttcgaagaatgtatctccggccgcctggctgatatttccgcttattgagacaaacagatattttgtaacccaacctccgatgacgcagtaataagggaaaataataaacggtatgatactggtcagataaccgataaacttatattttttattaaaataggaaaatgcatgtatggcactttttccggttctccggccaatagcaatctcggtgatcatcagtgtaaacccaaaggtcactgcaaggatcagataaatcaaaaggaagctgccgcctccgtatttagctgccaaatatggaaatctccatatgtttcctaatcctaccgctgatcctgcagtcgcaagcacaaagccaattctgctggaaaagccgcctctttcttcattcataaatctgtgaaatcctcctttagtttatactacgtcgacatcttcacctgccaacacagcattcatatttcgaacggaacacatttttccgcacatggtacatgtatcttctctttcaggttttgattcagcgcggtaccttcttgccttttcagggtctaaagccagatcaaactgggcctcccagtcaagcttctgccttgccttggccatctggttgtcccaatcgattgctccttttatgcctttggcgatatccgccgcatgggctgcaatctttgaagccataatgccttcttttacatcgtctacatttggaagacgcagatgctcggccggtgtaacataacacaggaagcttgcaccggatgccgctgcaatggcacctccgatcgctgaagtgatatggtcatatccaggggcgatatcggtaaccagcggccctaacacataaaaaggcgcacctttgcatatagtctgctgaattttcatatttgcctgtatctggtccattggcatgtgtccgggtccttcgatcattacctggacatcctttttccaggcccgggccgtcaattctcccaaagttaccagctcctcgatctgagaaatatcgctggcgtctttaatgcaccccggacggcaggcatccccgaggcttagagtaacgtcatattcattacaaatgtccaaaatctcatcatagtattcaaagaacggattttcacagccggtagcttccatccaggcaaagatcaatgatccgccgcgggaaacaatgttcatctgtctcttcatggccttaaaacggtctgcagtactgcggttaatcccgcagtgtatggtcatgaagtcgactccgtcttccgcatgcattttaaatatgtcgatccattctctggatgtgatatccttgagagccttgttgtagtatacgatggcatcgtaaatcggaacagtgcccagaatggccgggcattcagccacaagctttcttctgaaggtctgagtgtccccgaaagaagaaagatccatgatcgcttcagcacccatggagacagcctggtttactttcttcatctccacatccatattcagacagtctctggatgttccaaggttgacattgatctttgttttcagggaattgccgatgccgaacggctttaagcatttatgatttttgttggccggtatgacgattgttccggcggcaacttcattcataagcttttgaagatccattccttcataggcagctacagtttccatttccttggtcgcgatgccggctctggcggcattcatctgtgttgtgtaagtcatcttacaacctcctcgtttcaatcagtcgggagggaatctaaaatgcagtatttagttttcggaacattactttttaatgtacatgcttccgttacaataagcatctaaatccctacgttggcattacccaaatcaggtatgatggtcgaaggttcatccttcctctcagcccgtaaaagctcccattttagtttcaaaaacgaccttaaaggtcatctttcgtattgtatcattgtttattagaaagtgcaatggtttgaaaattgcaatatcagccaaaagagacaatcaagtgataaaaactcatacaataagtttccagtttttgtgttataataaaggaaaggagaagcatttccgcggattacggggagtgcccaaacgcagttaggagtgagagaaaatggcaagtttaatattagagggcgggacattccggcctattttcagcgcaggggtgatggatgccctgctggaccgcgacattatgtttccgtatgtgatcggagtgtcagccggcatctgtgacggcttttcttacgtatccagacagagggagagaaatcttcagatccttatgaatcacagaaatgatcccaggtatgtaggaagacagaatcttatcaaagaaagaagcctgttcgggctgaattttgtatacaatgtgatcccaaataaattatatccgtttgactgggacaccttttacaaatatgacggaaaaatcctagtgggagttaccaatgccctgaccggggaaatcgagtacaaagacggaaaagacttggatgaggagtgcatgatgctgagggcaacctgcgcactgccgcttattttcccggcgatcaatctggacggtgttccttatttcgacggaggaatcgcagatccgatcccggttcgcaaagcgatacgggacggcaatgacaagcatttgatcgtactcacaagaccaaagggatataaaaaggagctcagcaaaagccataaggttacatcaaggctgctgaaaagaaagtatccgaagcttccggacctgcttttgaaccgtcatgtggagtacaaccgcactgtccggtactgcgagagactggagagagaaggaaaggctgtgattctcaggccggatcatcccattgacagttttgaaaaggatatcgatgtgctcagggagacttatcagatgggatacgatatggcaatagaaagaatagaagaaatcaaaaaactgtgatacaataaattagaagaagaggtggtcaggatggcaagaattttgtattcagagcggccgtatgtagaagaactatctaccaataagacaagaaatttaatagtaatctgtgaacgcctctttctgccggtgcaggcagatgcagccaagcttgaactggccggggagatcgccggcagactcatcgatgagccccaggttcttctctggatgcttcagttggaggcaattgaacttttgtttgaactttgggaacagaaggatgggcagtttgcactggagcccaattttaatgatcttcagcagctccggtatctgggcttcattcatgtggaagaggaccaggtggctgttaatatagaggcaaaggatctgttttattttattttaaagagccacaagtccgggaagatcatggaaaggcatacaagatgggagcaggttattttcgggatgctgtttacttacggtattctcgatgtatattactgctatgatatttttgtgcaggtgacaggggaggagatatcttatgacgagatggaaaggtttctcctgatccggatcgtattttggcgaagcggcatcctgctgcgcaatgagaaaacaaagcgcctgtttatggtgagccgtgaggtccttgaccggaacgaagtgtttgacgagtggaacgagtatcaggatcttaatttcaaggaatatacggaagatgagtatgtggcgcttgccatgggcaacggcgtgaccggatggccgggagtctccgagatgtttacttatattctggaggagatcgaggacgaccgctacaaggctatggtaattatgaagtccattattttgatgattcagaacggtgccagttatctggatacggttgtaaaagtatccagactcctggatgccgaagaagaggacgaaaagattttttacgattgtttgaaaactgttttttatcatacgcccatttatgggaaaaaaggccatacgctctcggatatggcgaagaaacaggacgacgtgccgtttcaggtgatcaacggcggcaaaaagatataggaggtatcaatgaagcagtcaaatgtgcttgtagtagatgatgaaaaggaaatcgctgatttcatagagctctatttgaaaaatgaaaactatgaggtgttcaagttctacaacggtgccggggcactggaatgtgtggaacaggagcagatcgatctggcaattctggatgtgatgctcccggacattgatggctttgaaatattaaaagaaatacggaaagaccataactttccggttatcatgctgaccgcaaagacagcatctatggataagatcaacggactgaccctgggagcggatgactatatcgaaaaaccgtttgaaccgctggagctgatggcgagggtgaaagcccagctgcgccgttttatccgctataatgacggcagcggccagagcagtgaagatactctggagattgccggactggtgctgaacaggaatacacaccaatgtctgtatggggaagaggaagtgatactgacgcctctggagttttcgatcctctggatactcactaagaataagggaaaggtcataagttcggaaaatctgtttgagcaggtgtggaaagaaaaatatttcaagaacaacaacaatacagttatggtccacatccgccacctgagagaaaagctcggagaggtgatgggacataaagagctgatcaagactgtctggggagtgggatataaagttgaggagtaagtggaacaaataccggagcttaaaaatcaggattatgctccagaccttaggcatcagcctgctcgtaggtatctttggttatctgtttatttttgtctttgtggacggagtgcttcaggcgccgtttgcagacagcatggtgcacttttttgagcagttcggattcgacaatgagagtgctattcatctgtaccgtgcgatcttctgggataataagaccatgatcatttctacgggatttatctttctgttcttatgcagtttttatctgggtatgtccaggtttacaacctatttgaggcagattgaatccgggatcgatatgatcctgacagactccagcgatctgatcgagctggagccggaattgcagcctatggaaaaccgtctcaatgagatcaaggtcagtctgaaggaacagcgcaggcaggcccaggagagcgagcagcgcaaaaatgacctggtggtatatctggcccatgatttgaagactcctctgacatcggttattgcatacctgagtcttttaagcgaggcaccggatatgcctctggaacagagggcaaagtatacagatatttctctggagaaagccaaacgtctgggggacctgatcaatgaattttttgagattacaagatacaatcttcagaatattactctggaaaagaagacattctatctgtatgttttgttagaacaggtattggattcttttgaaccggtctttaaagaacgcggcctgacctgccacacggagatcgaagactcgatcctgatccacggggacccggacaaactggctcgtgtctttgagaacctcttaagaaacggagtttcctactgttacccgaattcagctatcgaggtcagcgcatcgggagaagaaaaagagacggtgatcaggatcaggaaccaggggaaagagataccgaagcataaacttgagaatttatttgaaaagttttaccgtctggatgaagcacggtctacggagaccggcggagcgggccttggtcttgcgattgccagagatatcgtagagcttcatcagggaacgatcactgcgaacagtaataaggatttcacggagtttattgtcagacttccaatggaacagaaggaggagccatgaaaagtacttatgtaatcgggcacaggaatccggatacggactccatctgctctgcgatcgcctacgcgaatctgaaaaatcaggtgaacggagggggatttgaagcccgcagggccggcaacgtcaatggagagacgagttttgtattaaagcagtttcaagtgaaggccccggagtttttgagcgatatcaggccccggatgagcgatatcacgctgcatgaggtggaaggtgtcaggcaggacatctcgatcaaagaggcaggggatcggatgaagaagctgaaactggtggctcttccggtcctggaaaataaccgtctgaaaggcatggcaacgatcagtgatatcgcccatgcggacatggatgtttatgacagtgaaatactggcaaaggcaaagacaccatatcaaaatctggtcaaaactctggatggtgtgatgacggcaggcaatatttcagatgttatcgatcacggaaaggtgacagtatctgctgccagcatcgacaagatggaacagtttgtgacagagggggacttggtgatccttgcggacagagatgatgcccaaaagcgtgctattgagatcggcgcccagtgtattatcgtatgtatgggcagcaaagtgagcagggagatccaggagatggcagagtcaaaaggatgccggatcctagtgacgccctacgacacttttacagccggcaggctggtctgccagtccatgccaatttcctatgtgatgaccagagaaaatatcatcaccttttcttccaatgactatgtggatgatgtgaaagctctgatggccaaaaagagattccgttattttccggtccttgacccaaagggagagtttattggtctggcatcgagacggcgtatgctgggatttgaaaagagaaaaatgatccttgtagaccacaatgaactgtcacaggccgtggagggactggaagagtgtgagattctggagattattgaccatcaccgtctgggctctatggagacgatgtcgcctgtctatttcaggaaccagccggtaggatgtacggcaacgatcgtgacacagatgtatgaagaacatggtgtggagatcacgaagccgatggcaggtctgctctgttccgcgatcctttccgatacgctcatgttccggtcaccgacctgtaccccggcggatgaggctgctgccggaaagctggcagagattgcagggatagagatagaagaatatgccaagcagatgttccgtgcaggaagtgacttgaaaggcaaagctgccgatgagatcttttatcaggattataagaagttttcctcaggagatgtctccttcggagtgggacagatcacgtctttggatcagggtgagttagaggagatcaaagataagatcataccgtatgccgagacggtcagaaatgaacagggattggatatgatctattttatgctgaccaatattctggaagagacgacttatcttattatgatcggagataagagcagcggcatcatttcacagggctttggagccgagacagacgggtgtgtcgcaaagcttccgggcgtgatgtccagaaagaaacagttaatcccgaatatactgaatattatacagcagtagtctggcggtcatgccccaaattacatgctttttatagcggtatagacaaacttcatttttcccttttgcccacgggtagttctccccgtttggaatgtcggcaaaagggaaatttttttgcggttttgtcataagaacattgctgtaatactccggttcattttcaaggaagaaatcaagtgggacggtaaagacggaatccacctcatcccgggaaaactggccgtggtaatcacggagttccgcaaggaacggttctatgcgtgtctgatacggagtcagaagataatccaaagccccataaacctgaatggtctctttttctacaaacaattcttccatagtctcccggacagccgcttcataggtcgattctccaggctccactttgcctccgggaaagcagacttctcccggctgtttgttcaggtgttttgcgcgcacctcaaataaaacgtggtactcatccccctttttgatcagggggatgagtaccgcaaatgacatttccttttcttctccgattcgttttgggatatgatgttttaaagattcaaacatgggattctcctaaaatctaaaatctcgttttccttcatggatattctcaatatattcttttgctttttgttttaccaccggattcgtgatcgtttccaaagcttctttgatcactttttctcccttttgttttgtatcctcagaagcataatcttccagatactctttgagggtcatcatggcgtttggaccgcagcagttggcaatctggccggattttacaagagacatgaagcggtctccggtccttccttcacggtagcaggcagtacagaagctcgggatatgacccaggtcgaggagccagttcacaacttcatccaatgtacggtcgtcactccgctcaaactgcgcagaattgtcttccggcttttcgggctccgcataacctcccacgctggtagaagatgcaccgctgatctgggagacacccactcgcagcacccgctctctggattcttttgtttctctggtggaaataataatgccagtgtacggtactgccacgcggagaatcgccacgatcttttcaaaaatgtcatcattgattccgttttcaaattcatcaggatctacatcgtctgccggacggattcttggaacactgatcgtatgggggcctacgccgaacctggcctccaaatgttctgcgtgcattaaaagtcccgcaaaatcatagcggtacatgttcaggccgaataaaacgccgatgcctacatcgtcaatgcccgcttccatggcccggtccatagcttccgtgtggtatgcgtaattgtgcttcggcccagtcggatgcagaacttcataattatctttatgatatgtttcctggaataaaatatacgtaccaatccctgcatcccgcagccttttataattttctaccgtcgtggcggcaatatttacattgacgcggcggatcgctccgtttttatgtttgattccatatatggttttgatactttctaatacatactcgatcggaatattgaccggatcttccccggtttccagtgcaaggcgtttgtgccccatgtcctgaagtgcgataacttctttttttatttcttcctgtgtcagctttttcctgcggatatgtttgtttttataatgatatggacagtacacacagccgttgacacagtagttggcaaggtagagaggggcaaacatgacgatacggtttccgtaaaattcctccttgatcttaatggccaggtcaaagaccttctgtatcagctctttatcctgacatgccagcaggaccgaggcctccctgtggcttaaccctttcagtttttttgccttttcgatgatggatatgatcagctctctgttatccttattggcgtcggcataggcaagggtatccttgatttcctggtcactgataaactcttctgcaatttttgaatctggttggtacatgatttctctcctttatttggtcttggcaaacattgattttacgctgattccttcaatcattccgagcttgccggacaaagtgctgatggtgttttcgggtgcgtctaaaacaatggagatgatattgatctccttttcgcggtagggaatgcccattctgccgacgatataatcccggtattcatgcagcagctgattggttggagttatgcctttttcttcctcaatgatgataccgatcagtgcaatccgtgtttccttcataataaaatgaacctccttatacaatagaaaaggcatatcccatccggaatatgcctgattatcacagtataaaatagagttttgtatacaaaactctgcgcagtttataaaggatcaatcttggcatcgggcagtaccctggcttcagaatgatatttttcactgcatttatagtagcccaaaacaggggaaaagtcaatcaacaacaaataacaacaagtgttcaataccgtctgtatggatagcttcttatgctagaataaaaaggaactttcacaggatggcctgtgagcgcagcagctgttggtcttagagaataggaggagagtttatgatgaaaaaatgggggaagatcgtgaccggtatttttttgacagcggcaatgctggccggaactttgggggcaggaactgcccaagaagttgtgaaggcagcaggaagcacgatcaaggcttccggcggtcagattaagctgaaggacgtaacggatgatggagtctttaatcaatactctgtaaccaaaacaaaaaaaatgaacattaaaatcgtagttccgaaagaatctacagtgtttttagatttttacggagtaagaggagatgaaaatgacaatgcctacctgaagaaaaattggaccataagttttcagggacagaagtggacggggagagctgtccggattgtaaagcatcttaaaaaaggaacttatacattaactggaagtatcagtgagcctcagttcagtgtaatcgacgcagggtatgtggattccggcagcagcaggttcacatctgccaaaaataagattaaagaaggaacgggaaaatggaattaccagacgtttaaagtaaagaagaaaagccatatccagaccgttggccggacttttaagtataagtcaggaatcattaaggcagggaataacagccatttgtctgaggcctataaaaaatcagttcccttctatattcagaagaaaggcaaaaaaggaaaatatacagcggtaacaaacaaaatgagttatacatcaaaaaaaataaacaaacactttgcattgagtccgggaacttaccgtctgaagacaaagattccgaaaggatatgtgtcacagtttatgtatgtggatacggtatataaaaatagttatgcggtaacaaaagcaaaggcaaagcttctgactccgggcaaaaaaaagagcaatttgtttaccgatgcggataaagcgaaaaaaactcattattataagtttaaggtttcaaaaaacggaaagatctccatgaagcttacaacgaaaaacaattccggaaggatcaaagccgcagtttacggaaaaggcatgaagacgaagaaaaaaacaatggaatattcaggaacacattattttaactgcaaactaaagaaaggtacctattacataaaggtgacaaaagatacgaaaaagtccacaggtctttacagtctgacttattcggataagaccgaatccagataaaataaaagataccgcttttataaagagtttgtaaaagcggtatctttttattccattttttcttcagccagaggaagggtaacggtaaagaccgtatatcggttcttcttggatgctgcctttatggttccgccgtattcctccagagagatccgtacaaaatataaaccaaggccccttgttccggggctgtttttcgtgctgaatttgtagtcaaaaatgtgcgggaggtcaccagaagaaattccttctccggtatcggtaaaggtgatcacagcctgctgtccggtatattcagcgtcgattgtcagggagccttccggcggagtatgctcggtggcgttcaggattatattttcgaatgcccggaaaaggcgggttttttgatgccaaataaaacaatgattttccggaaggtttaagttgtaatagatgccgttggcatccgtatacggttttgtctccatataaacataggttaaaaaatcattgcagtctataaggcagggcggttcatgaatcttatcttctgcgttaaaaatctgcaggctgctgatatcgctctgtatctgagaggattttttgtcaatgatctctaaatactgccccaattcttcatcaatgttaattccgccctctcgtataaaatcaatataagttttgatcgccgatgcaggggctttcagatcgtgtgcggcaatcgagagaaatttttttcgctcttccagcatcttcgacagacgggcagtctttttatccacttcttcctgaagatgaagagtcagacgttgatttttcaggatcaggttttgattataccggatgatcaaaatcataaaaagcagaaccatcagaaaaccgctgtactcatcctgccatccaaaccggaggggttcatagtctcctccggtccacagatcggtgaaaagtccgaatccaaacactgcatttcctgccagcagccatacagaagaccggtcattcaggattccaaggaaggacaggaggatcaaataaaagctgatcagcagcttagaagtatagatgatggttccgtaaatgctgacgatattatgaaatgccggaaaaagtacataagtaaaaatgacgggagatacggacatcaggaccgtaaacacgtaaacagcaatgtgcagtctggccggaagaattcctctgcacagccggctggtgagcaaaaccatgcaggcaagcattgcaaaataggacacatcttcaatgagataggaggttccccaaagatcccatccaagccagtgaaaaaacggatagctgacatgaattgagaaaaacaggcagaccagtccgtatgcggcaaagaccgggtccgaatgtttccggacccagacacccagtgatgtgacggccgctcccagaggaaaaaagcacagcagggcatagaagatcattttctgtgtcagggcatttgtaacggcactgctcgttcctaggaccggaggataggtaagtccgctgtaataatgggtgtcatttgcggcctgaatgaccaattcgacggttccggagggaagaggaattaatgtattctgtatatgccgggaaacgggaactgcatcggggctgcccatttgccggaccagcgtttggttgacatagatacggcaggaagagaaaatttccggcacttcgagcatccaagcgtctttagaagaaggaagatttaaaactttacggtaagtagcggcgccaaaaggtgattgacttggctgatgggatgaaaaatttccaaattggccaatagtgatgatttcaggagactctgcggatcctgcagaaaaatcctttggtgtgtacagacggccggaataaaattcccactgtccggtcagaggaaccagatctttagagggatcagtatttgatgaggtatacttattgtccatggaatagcaaaaggtaaagagcaaagcagcaaacagcagagcggcggcgaggataaagacggataacagtttctttttggatctttctgtttttaagtgcatggcagactccctatagtttttgtttactctgtgaagagatacccttttccccactgtgttttaatatattctttttcgggagacagtacctggattttcttccggatccgcataatcaggatctgaatactgtgtgtattataacaggactcaccccataccgcgcggtaaatttcttcctgccggtagggaatgcctttatgatccattaaaaaactcagaatttcgaattcattgaccgtcagattcagcggaagatttccaatgtatgcctgcttttcgttattatccacggacagtccgggcgtccggcaggaaggaacggtgcagcgggagtttcgtattctggccctgatcctcatttccagttcttttaagagataaggctttgtaatataatcatccccgccgcagtcaaaactttctatcatgatctcttcatcggtcagattagtcagaaagatcacgggtatgctgtaatttgcacgaatcgtccggcagagacagaatccatccgttttttccatatgaatgtccaggataatacactgatacgtgtgttctgacaaacaggaaagagcagccagggcatcggtagcagtgtctgcgtgatacccgcatgtttcaaaatacttacggttaatttcaaggatttccaagtcatcatccacaaacagcaaacgttccatagtcggggctcctttcatgattttctatactcagagtatagatgtgttatttttattgtaaacatatttcagagcctttgcaattttaacagacaacgttgttatttattgtgaaacagaattcaatcgggtggacgtacttcgtacgataaggtaatattttgtttaggatctatgggacgaagagaggactgcaaatgaaaaagaattataagaaaatgatctgtttatttttgggagttatcatattgaccatggctcagccagttttctgctctgcatggggtcctcccaaaacagaggatgaagagaaatttttagaatggtatgagaagcataagaatgaccagaatgccgtctatactctgacaggggatctgaagctgacaaaggggactaaggaagatcccatccgatttgacggcagaggcaaagtgaggattgactgcgggaatcatggaattattgtaaacagcagagtgatcattgataatcctgaacttacgataagcggaaactatatgtttgtactaatggaaaacagtatagactctcatcttattttaaaaagagggacggttcttgacgagtccgacgatgcatgtgcggttcaggttatccgcggaacccttcagacttcatctgatccgtcggacaggtttacgattcagatgaaaggaaaggatatcaccggaatttatcatggcacagatgagccgctggtgcttagacagatcaatgttacagcaaaaggcaaagggcgggttgagggagttaaaaataatagaaaccaaacgttgtctttgacagattgtaatataaaagtgtccggagaccaggaagcgtgtggtgtttcgaatctgggcaggacagaagtgaaccgctgccgcattactgcttctgtcagtgatgcctcaggtactgcagtcagtgttgccggttccgaaatatccagcagggattctaaaatagttccggaaatcacgggcatgaaaaatacagtctacagcatttatgatgttgacagctttactcctgtcatcggcagaactggcacagaccttaaatcccttctgccgcaaaatgccagtgtttacgtggaaaatgcagagacagaagagaaaagtattatttcaatgcctgttatatgggatgcttcaggagcagatacttcaaaagaagggattacgcttgtgaaagggagacttctcacaaaagatctgtttgggatttacatcaattcgtcaggaatcagcccggagacagccgtcattgcggtaccgccggagggaatgtttttaaacagttacaggattctgtcgaaggaagagggacggatcaggggaatgctggaactgccttatcctgccggcgcagactccatgattcttcaatacagtgcggatcagaaaaactggaggacttatgaagaaaaaaacggcagtacgaatatcattcgcggccaggactttccaaaaccgttcggagtcttcagctttgtctttgacatacctgtaaatacaaaaacgttttatatgcgtacaaaggttcatggcagtagtattttttcaggaaccagcgccgtgtggaaaatagacgtagaccatggggctccggaatcttctgtcagcggggaatccggtggagacagaggcggacagactgtagaacaggaggaaagtacgcagaaggatcagaggagtgaaggcaaacccgggtattcggaaaaatccgttaggtataaggataaaaattctttctcagatcaaaagtctgagaagagccaaaatgtgaaaaaaaatgggtcttctcagagacaggagaaaaagaaagaaaaagtccagggaaaaaagacagccccggaggtacaggataatgaaaaacaaactccaaaaacgtctggatgggggagaaatgcaaaaagctatgataagggagaccttgtttttgcagctatagggattcttctgatttttggagcagcactgctcctcggcaggaaatttttccgtaagaaaaatttgtcatagttcatgtcaatatttatgacagcatgtaaaaaatatggtatactgataggacaatcaatggagtagaaaagtatccttgatttgaacaaaaacaggaggaactaagatgagtggtagaaccaatgtggaattgggaggtattacactgctgggaaatcagcagacaaaatatccggatgattatgcaccggaagtgttggagacttttccgaataagcatcccgaaaatgattattttgtaaagtttaacgcaccggaatttaccagtctgtgtccgatgaccggacagccggattttgcgactgtttatatttcctatgttccgggagagaggatggtggaaagcaaatcccttaaattgtatctgtacagtttccgcaatcatggagatttccacgaggactgtatgaatattattatgaaggatctgatcaaactgatggacccgaaatatattgaagtttggggcaagtttacgccgcgcggcgggatctccattgatccatactgcaactatggcagaaagggaacgccgtgggagcagattgcctttgaccggctggcacatcacgatatgtacccggagaaggtagataaccgctaattttgagaaaataaattaatatgggagcaggcagctgctgtgcttttggatgttgggggactcagtcagaagtatagcagaaaagacataataaaaaaggagaatgtttatgaggaaagttttaaaagccgctgtgtgtctggggctgtcccttacattgggattcagtactgtggcatttggcgcggagaagaaggaagatatcacaagtaaagtaggtgacaagaaaggtcaagtgtcatcagaaataaaaggaatggaaggcatccaggatgttaagtcaggccaggttattaaggttgcaaaaaaatcaaaaggtgctcgggctgtacaaaacactactgcttatagaataaacactcaggctaatgtaaacgcaatcaatcagagaattcaaaaaggtcagttcaatgttgtaggtccgattacaaccagtaaacaagtagtagctaatatttatatgcctacaaatggtaaactctgtgtggcttttggaaactcttatgttgatcagtcaaccggattgattacctcaacacctgcaaactgttctgttacaataaccgacagcaggggaaattctattgcatctagttattccgacgatgatacggtgatcgccaattatgtaaataaaggaacgtacagattaacagtgtctgcaccttataattcagctgttgctacaggctaccttccatattattactcaagtgataacggaaatttatctggaactgcaaaatatatagcaggtaatgggggaaataactatcagtatttttcagtttcaaagaggagtcaggtttggacagatctggtttcagccaaaggatattctttaaagagtcatattgaaaagaagagcgggaaaaaatgggtaagaattacagatcaaaaatatagttataattcaaatatcaggagatatcatgcattaagcaagggtagttaccgtcttgttatatctggtacttctaaatatgatttttacactgcaagatatggaaaaaaatcttataccggaaaatatggtactaaaaagtcaaaatcaaaaacaatcaaacgcaagaaatcaaaaacaaatgttttaactgcctctgatgcaaagaaaaagtcacattggtataaattcaaagtgacaaagagacgttccacacagtttaagattactacatataacagctctggaagtgtgactgcaaccttatacaaagggaaaaagaagatgagctcacgtaccgcttataatccaagttacattactttctcaggaaagttatcaaaaggtacatattatgttaaggttacgaaaaacacgaaaaatacaagcggaaaatacattgtaaaatatgtaaaataagtaaacagtaatctttgcagcagagccggctggctctgctgcagttgaatgaatgctcaaaatacacagaagtttaaaaggagaataggttatgaaaagacaaatgaagaaaaaactggcggttttattaagccttgtattgatcgtttctctcgcattagccggatgtaaaaagaaagaggaaataccggagccggacaagcttgcagaggcttattatcttctgtttaccagaggaaatacaaaagagatagtcaaatacggacacacagaagcagaagcaaaaaaggcattaaacacatacaaaacaagtatgaaatcttccttcatgacatctgcaaatactgccggaaatatctttaaatctgaagatgcagataaagtgattgacgcacttctgcattccttatctaagcttaaatatgaagtgaagacagacgaaaaagatgagaaagaaggaactgctacggtgattctgaaatctcaaagtgtgaacctgagtgaaatacagtccaagcttatggcgaatgttagaaaagccgcagcatcagggaaaataacagaccaaagccagattggaacgtatgtccttaccgagatggcaaaattgatcaaggaaacaaagcctacgaaagagatgaaagaaactacgttaaaaatgaagctgaaaaaggtaaaaatcaataaaaaagaagtagagcgatggatgcctgaaaacaactatacttttgagatgcagattgggagacttctcataagccagtaatttttggagggagataaactgaatttcagatagtcctagtaatcctaagaattccttcaggctattttattttttctttagaattgtttattttctatccattgtttacggggaggattctgatatacttaaaacatacctgcagggcacaccatattttagccctatggttggacgtgctttgcaaggcaaagtttagtttttcatatatattaatcctctcttttcattaaacagacggccccgcagcttttgctgcggggttgttttgatgtgacattttccgccgcggtatggtattataggaacacacatgttggaatgatggaggaataccaggatgtttaacattgaagaagaattaaaaaagcttccggccaagcccggagtttatataatgcataatgacaaggacgagatcatatatgtaggtaaggcgatcaaactctgcaaccgggtcagacagtactttcagggaagcagaaatttgacgacaaagattcagcatatggtatcgcacatcgcatattttgagtacatcattacagattcagaactggaggccttggtgcttgagtgcaatctgatcaaggaacatcgtccaaagtataataccatgctgaaggatgataagaattatccatacattaaggtcaccacaaatgaggaatatccgcgtattatgctggccagaaggatgaaacaggacaagtgcaaatattttgggccatatacgagcgccggagcggtaaaagatatcattgagctgctcaggaagctgtttaagatccggacatgcagccggaagctgccgaaagatatcgggaaagacaggccgtgtctgtattatcagatcaaacagtgcgaggggccctgccaggattatatttccggggaagattatagaaaatccattgatcaggtactgagttttctgaacggaaattataaggatgtgtcggacatgctggaggaaaagatgaagcaggcagcggcagaccttgagtttgaacaggcagcagaatacagaaatctgttaaagagcatcggcaagattgcagaccggcagaagatcaacagctatggatttgaaaacagggatattatcgcatttgccaaagaaaagcaggacgcagtggtcgccgtattttttatcagagacggcaaactcctgggcagagagcattttcatatgacccaggatgaggagacaacagatgaagaactcatgagtgcctttgtaaaacagttttacgcaggaactccgtatctgccgggagagatcttcctggagtgcggcatggacgatatggagattgtggaagagtggctttccaagaagaggggcggacgggtgcatatccggattccgctccggggagaaaagcatcgtctcgttgaactggcaaaagagaatgcgtccaatgttttgagacaggataaagaaaaactcaagagagaagaaaaaaggaccatcggagcagtgaaagagatcgagcagctccttggaatcaaggggcttcacaggatggaggccttcgatatatctaatatcagcgggtttcagaccgttgcctctatggtcgtcttcgaagacggaaaggccagaaagcgtgattatcggaaattccgcctaaagacagtggacggcccggatgattacagaagtatggaggaagtcctcacgaggagactcctgcacggacaaaaagagatcgaagaattaaaggctaaaaatgaggatctggaatttggaagttttaccaagtttccggatctgctcctgatggatggaggaaaaggccaggtaaatgttgctcagagagttttaaaagacctgaaaatggatattccggtgtgcggtatggtaaaagatgacaatcatagaaccagggcattgtactataataatgacgaaatctattttccgaaaaggagcgaagcattccagctggtcacaaggattcaggatgaggcccaccggtttgccatcgaataccaccggtcgctgagggcaaaaggccaggtcagctctgtactggatgagatcaaaggtgtagggccgaagcgcagaaaagcactcatgaaacattttaagcagatacagaacatcaaagaggctacggaagatgagatcatgcaggttccgggaatgacaaggaaagcagcaaaagagatctattcgtttttccatttgtctaaggaagaaaatgtgataaactaagaataacaatcggacaaggaggattcattatgagcgaggaatacaaagtatcggtggcagaactggcaaagaagctggaactgatcccggtgatcccggaaattaacaccaatgacatttatatcacccaggcagaagtaaaccggccggcgcttcagctggcaggcttttttgaccatttttcatcgtccagggtgcagattattggaaatgtagaatatatatatatcaataatattttggaaaaggatgaaaactgtaaccagattctggaccgtcttttcagtgcccagattccatgtctggtattctgccgtggaaaacagccgtgtgataagatcgttgactttggaaggaaatacggagttccggtttttatcagtaaagattcaacttcagagtttaccgcagaagtcatccgctggctgagtgtggaactggcgccccggatttcaattcatggagtgttagtggatgtattcggcgaaggaatcctgatcacaggggaaagcggcatcggcaaaagcgaagctgctttggaacttctgaagagaggccatcggcttgtttcagatgatgtggtggagattaagcgtgtgagcaaagataccctgatcggttcctcaccggcagtgacccggtttttcattgaactcaggggcatcggcatcattgatgtaaagaacctgttcggtgtggagagcgtcaagatgacccagagcattgatcttgtcattcagctggaagactggaacaaagaaacagattatgacaggctcggactggatgaaaattatatagaatatctcgggaataaggttgtggcacacgcgctgccgatccgtccgggaagaaatctggcgattatcgttgaggccgctgccatcaatcaccgccagaagaagatgggatataatgccgcggaagaattatacaaacgagtgaccgggaaattggaggaataagcagaatgaattacatttatggagtcgatgtaggaggcaccaccgtaaaactgggactgtttcaggaggacggaagcctgaaagaaaagtgggagattcccaccagaaaagagaacggcggggcctatattatagaggatatcggagcggcgctgaaagaaaatatcgcatcccatgggatggaaaccggacagctgattggagcaggagtcggggttcccggggcagtactttcttttgaaaaggtcaatgaatgtgtcaatctgggctgggggcaggtcaacgtggctcaggaactgggaaaactgctggactgtcctgtcaaagtgaccaacgatgcaaatgtggctgcgctgggagaactttgggctggtgctgcgaaagattaccgcagtgctgtcatggttactctgggaacaggtgtgggcggcggcatgatcgtcgacggacagatcatcaacggaagccatggatatggcggtgagatcggacacatgacggtaaatccggcggagacacgcaagtgtaactgcggaaagaccggctgtctggaactgtacgcttcagcgacaggaattgtatatgagacaaaaaaagcgctgggggaatctgacatagaaacgccgctgcgccgaatggacggcttttcggcaaaagatatttttgatctggcaaaagaaggagacgcctttgccatagaacaggtcgaccggctgggagagaagctggcaatggccttcgggaatatcacactgacagtagaccccgaagtatttgtcatcgggggaggtgtgtcgaaagcaggagatatccttcttgacgccattaaaaagcattatgggacatacaccttcggcgctgtaaaagaagggaaatttattcttgcaagtctcggaaatgacgcaggaatttacggggctgcaaggctgattaaaggagaatagcatgaacacgattcttgaagaattgagacagaagatcgcacccgaacgggtacttacaaaagaaccgatgaaaaaacatacgaccttccggataggcggagaggcagaattgtacattattcctgaaaccattgaggaagtgcagtggaccgtgaagactgccaggaaacacgaaattcccatgtttattctgggaaacggaagcaatctgctggtaggggaccgtggaatcgacggcattgtcctccagatttataagaacatgaatgaaatcacagtcaacggaactgagattacggctcaggctggggctttgctgagctctattgcccgggaagcacagaaccggagtctgaccgggtttgagtttgcaggaggcatacctggaacattcggaggcgcaatcactatgaatgcgggagcctacggcggagagatgatccaggttttaaaagaggccacagtcctcacgaaagaaggagagattcttaccctttccgcagaggaactggagcttggataccgtaccagcaatgtcattacatgcggatatacagtcctaagcggaacactctctttgaaagagggagatccttctgagataaaaaaacagatggatgaatattcaatggcccgaaagaccaagcagcctctggaactgccgagcgcaggcagtacgtttaagcgcccggagggctactttgccggaaaactgattgatgacgcaggactcagaggatatcaggtcggaggggcacgtgtgtcggataaacactgcggatttgtagtaaatcaggagaacgcaacggcgaaagatgttcttcagctgatcgaagacgttcagaaaacagtgaaggaaaagtttggagtggacctggaaccggaagtgaagcgggtcggaaagttttagaggaatttacgtatgaggtttgtaatcgtaaccgggatgtctggggcaggaaagagcagtgctcttaaaatgctggaagatgtcgggtatttttgtgtggataatctccccaccagactgctgtgcagatttgcggagcttacccttgacaagactgcaaatatttcaaatgtggctttaggcattgatatccggagcggcgcatcgattgatgagtttttagaagaattaaaaaaagtcaatgaaatgggtgtcaagtttgaaattttgtttctcaatgccagcaaccggattttgatcaagcgttacaaggagaccagaaggaatcatcctctggccaggaacggccggatagaggatggtattgaaaaggagcgggaagcagtcgatgttttgaaaaaacatgcggattatgtcatagataccagccagcttctcacaagggaactgaaggctgaaattgacaggatatttgtccgggaagaagaatatgctaacttcaatgtggcagtggtgtcttttgggttcaaattcggtataccggcagacgtagacctggtgtttgacgtaagattccttcccaatccttattatgacctttctctgcgccctctgaccggcaatgacaggcctattcaggagtttgtcatgaaacatgaagagtccagagtatttttagagaaattagaagatatgctcaaatttctgattcccaactacatcaaagaaggaaagtataatctggtcatagggatcggctgcactggaggaaagcaccgttctgtcaccatcacgaatgcactggcagaaaaattaaaacagctgccatatccggtgaaggttgagcatagagatataacgaggtaggaaatgtcattttcaagtgaagtcaaagaagaacttgcaaggcttacgagcggagcaagacactgtaaaattgcagaacttgccggtattctcaacttttgcggggaagtccgcgaagagaagggaatctatctggtcaaggttcatacggagaatgtatcggtggcgaaacggttttttacgctgctgaaagacacattccatatacatggagaacttcaggtaaaacgcaacgaatatctaaaaagaagtcgaaattattcggtttttgttgacaaacatgaggattgtgttttattattgaaagcagtgaaatatttcgaaccgaaaaactttggattagtcctgcagaacacgtgctgtaaaagggcctatatccggggagcatttctggcagccggttccatgagtgatccggagaagaattatcactttgaaattgtaactcttcatgaacaatttgcggtacaattgcaagatgtgcttgatttttttgaattagatgctaaaatagttattcgtaagaagtactatgtagtgtatatcaaagaaggtgccaagatcgttgatgtactgaacattatggaagcacacatagctttgatgaacctcgaaaatgtccgtatcttgaaagatatgaggaacacggtgaaccgccgtgtaaactgtgagactgccaacattaacaagacagtgtcagcagccgtgaagcaagccgaggatattcgatttttacaagagcatagagggcttagtgaactgaaccagggactgcaagacatcgcctatctgcgattggaacatccggaggctactctgaaagagctaggagagatgctgaatccccccgtaggcaaatcaggggtcaatcatcgtcttaagaagctgagtaagattgctgaagatatgagaatgggaggatcattatgatttctaagagtatcaatattcatgtgaccgagaacaaggaagaacgtccggttgcctttctggtccagatggccagccagtttgagagcaagatcctgatcgaggcaggcaacaaaaggatcaacggaaaaagtatcatgggtatgatgagtcttgggttggatgatttagataatataactgttgttgctgacggagcagacgaagaaactgccatcacaacaattgaaaaatatttgacaaaaggagcataaaaggctcctcatatgctgaaatagctcagttggtagagcacttcactcgtaatgaaggggtcgccggttcaaatccggttttcagctttggcgcaaacgctgtagatatcagtgtttgcgctgtttttttatatctttttagaaacatcaaaaacagttttttcaatgttttttcgatgtttcagttttcggaagtattttagaagtatagtttcttatggcttctttgtgcatcgtaggtgataagtgggcataatgccggagcattacttcaatgctgtttcccatgatttctgaaacaactttaatattaccgccatcctctccacgttcttcaagagtgttagaagcaaacgaatgtcgtccaccatataaagtcatttctggaagtatgccaaatggatgtgatctatgcttctttatgtaggagtctacctccatattataatttaaaagtagtttcttaaaatttcttgatatacattgggattaattcttcttccatctttgtatgtaaacaataaatcattttctaaaaaatctggttgtaaacgccaggtgttttttagagcaagacgcttttgtaataatactgccaactcatcgggtataataagctttctgtgccttccagggcgtttcatatctgatatgcagtcgtatttgtctaatgcctggtgcaaagaaagaaaagagcttttaagatctgattcttgaaatccgcaaacttcctcaggagccatcgctgtagaaaagcttaagcataacatatcataatagaaagatgccttaacactttgtaaagacaagaaatagttaatctgatcttgagtccaaactaattgctgcttaggtggaagggtgtactgttctacatcgtgacatgggttctgggttattatatgtaatggacgtatagtatattgcatcattgaactaaaaacactctttgctttattaatagtgcttggctttagtttttcattgggtttgtttttaggagactgtttagaaagttctgccatccaattttcaatatgaattggaagaattgaactcacttcaacatcaaaaaaagcatctttaatataagaattaacacgggagtgtaagataaagtgtgtaaattagtaaccaactaattacacactttatcttacactccctataaaattaaaatttacatagtttgcttgacaaaccctctccgtctgaaattccgtcttcattacccaaactatcttatgaaccattttgcctcttgacacataactgattgtttcgattcctctatgcggatgcattggaaatcctgctgtataatcatcaggattaacgctgtcaaaagagtcaagcattaaaataggataaaactcctttgttgtctgattttctaagactcttactaagtttacaactgctccatctgttgttctaaaaccttttactttagtcttcactgttctttccattaaattttcctcctattttcttcaaaagatataccagtttttctttttcttcttgatccaatacttccatgctttctgttatcatcgcttcatttttaggtgcaattttgctaataacatcatagccttctttcgtcagatgcagtatacatacacgcctgtctttctcgtcagataatctttcgatatagttcattttttcaagttgttcactattagaggtatggttcccacgctactgagtattctttcccttacctctccgacgctcatatcgcctttactgtaaagagcttctaaaaccataaattgactaaaggttaaattgtattctgctgctattttggatgtttttttatgtaaagcatttacatttctgtgaagtccgatcaaaattttcatttctgttctgcccaaaagtaattcacctcctttaattgcattgtatctaactagatattatctatgtagatataattttgcaccagatttttttgtaaatatacattgttactataaatgagtaaattaaaaaatgcacaaaactacattgctactttcgtaaataaatcaaaatcgctacttgcctttgcgcattgaaacagatacttctcttgctggatcatgtcacaaatcaggcggtatccagtttcaaaagaactgtatttctccgttcctacgagacaaatataatgtgatagtgacatcagcagccagtatctctggattccctttgaggaacttatctggtatgcagccagtgccagtctgttttcacatcacctgaaacatacctcgattgcccatccgcatacataacacgaaagaatttccagtgtcaatgattctgtatttgtgctgataaaggcacgtaatgccctgggatttgcaaatgccttttcaggataactcaaaaggacaaccgcgttttctttaccgttgagattaccttcataccgtacgttcggtttttgactgtcacaaggtcaaagttcgaatgtattgccagtaaatcggcggcaaattcacggatactttgatattttttatagatcaaaataaagaatctttcttttctaatatttcaccaatcttttcataaatgactactgcgtctaaaaaacgatatctttttcataaggatttccctttatatatttttcccataattttttttgttgccatacttacttttaataaatctgctatctctttatactgatttaccaagttgagagttcctttatactcacttgttctttctatcgcttctcttaatgtaaatcactaaaatcaagcgtaatttacacgttttgcgcaatttatacaattaactttttttggtggttattgtatagtagaaaatagttaagattgtttttagatatagaaagggaaaaaatgtgtattttcattccatttgttgtgcagagatattttattccacaaataaagaactcttttatccgtcttaattaaatagcaggaaaaggggtcaatgctctttttatttacaactttccataaaattaaggttatttaatatattttgtaacaaaaaacaggtagtttttgacactaccaagcactatgagaagggcaaagaatggaagccagaaagtgagtgcttacataagaaaggggactttttatatgaatttaaatgagcaggatttgaaaaaagtcaaatccttacatgtcatgttgaaaatgccggtatggatattagaaaaagaaacaaataaagttttaaaaagctataaatcagtttataagcatcctatttcttatgaatttaaagaaaggaatatctcagaagaagttgtacaattttatagcggaatgttaaatgaaatttttttatgtctgtggtataaggatgtaaaaatagtgattggagcttttagggttaacaatgttacaagggcagatttttctcatgtttataataatctaatgaaagaaagcaaaaaaattttaaaagaaaacgagtgttgggaatattatgtatcgcttcccgtatatcctctgggagatatcagagattgtttgattcttctgggatttttgtttgatatggatttggaggatgtttattcgaaaggactgcatgagcaagtggcgcaaaaccagttggagttggtgagaaaaccatctgaagacacggtgtatgataccttccgtgtggagcgatacacatttgattatgaaaataaaatcatgaatcttgtaagtcagggcgatattgaattattaaaaagtggccttgtagaattgggaacaagtgttttgccaattttgactagcagttctttgaaaacagaaaagaattatacgattattattctggaaaaactggcatcactggcaattcaggtcgggaaggatattctttcagtaatcaaactgagaaattattatattagaaagctagaggaacaaacagagtttataggggttctggcaacgcgagacagtgcgatcatccattttacaaaagaacttcatggggtatcgaatcaggccagaacatccctgattcgatgtatcttacaatatattaatttgaaaatttatgacaatatcaaagttgcagaacttgcaaaacagttctatttatcagaaagtgcacttcgtagcagatttaaagaagaaataggcgtatccatcaatgagtatgtcaaccagagaaagattgaggaatcaaagatgatgattcagtcaggggttccgataggagaaattgcaaggcgtttgagcttctatgatctgtctcattattaccgcacttttaaaaaatatacaggtgtgacaccacagcaattcagggatacaaatattgtggtatagaaaatcagacctgttttgattggaaagggagtgattcttatagaagaatctgaattaaatgattagataaaagataatcaaacacaagaaaggagtaaaaagaaattatgatacaaagaaagttaaaaaagaaattctcaatgcttttagcactgattttaacttttggaacaatgttctcaggtacaatgtctgtacatgctgaagaagctccacaggaaattttaagtttatcgtttgatatggacgaggtaaaagagccggttcttggagatacagtaccagatagttttaatgttcagccaaatgatgggaacagccttacagatggtggtgaagtatttgcaagctggagggtaaaacaggctgacggaaattggggttacgcaaaacccacatcggaaacagtgcagtttgaggctggaaaagagtatcgcttaagatttgatatccagaaccttaaggcagcagatggaaaaatatttcatgataatgtccctgctgttaaagtgaatgatatggatgtatctgtcgtgacggacgataatgttacagattcttactataccaagacagatgatacaacagtatcatttgcgatgtattcaaaatcctttaaaatagaaaatatactatcggaagttccgccagcagaaacaccagaaaaaacatttatcgttaccaaagacacggatggctctgaaattggccgatatgacacgcttcaggatacactgggagctattaacagtgataataaagataagtggaatgcatataccgttatggtaacccgtgattatacagaagatgacaaggcaccaggcattcctatgaatgcgacggtcactgttacctcatctccaggaaatcaatttgtgattacgcgtgtaaacccgggtaaggcgtggtcatcaaggcattttaatgttggcggtgattcgtccctgacgctgaaaaatatcatccttgatggaaacaatgccatgggaggtatttattcggatggaggtgttggaacacatacaagggctaccacgatcatcttggatgagggagcagttataagaaactgccttgggcgaggatctgatccgtatactccgtggtcaggcggagcaatcgttaccttaggtaacggcaaaggcgtagtaacgactattaagaaaggtgccgtaatcgaaaactgtaaaagctcagaaggctatgatggcggagcagtctatgtagatgaaggtacacagcttaacttagaaggtggtgttattgaaggctgtgaagcgataggcactgaagttacagttggggggagtatccgtcacagtaatggtggcgcaattatgttacatggtacaatgaacatgactggtggcataatttctaataacaagacaactgccagtggaggtggtatcgctgtatctgatactggcagactttctataacaggtggaacgattaagggaaataatggagcgcatggcggtggtattttcattcaagaaagtacatcagaaactaagattgaaaatgtcacatttatgagaaatcaagctaaatatggtggaggagtatacctacacaagaatgccggaataaatgtaagtaacagtacattttccaataattttgcaatacaaggcggtgcaatttatactggaaattctgattatgacaatccggcggatacaggtaaatatcagactgttaaacttgcaggtgatgtgagcttcgaaaacaactctgcttcatatggactttacactccgcctgaaaatgcagatgaatttacgaatcttaaattttcgaaatcatctgtgacaggtaaaaatatctttcctgtggattcacttttgacaaactatgatattaactatatcaatggggataagattgatccaactgaaaagtatcaaattcgttttgagtttaaaagcacaacctcagaaagagatttaccaagcgatatattggatttgcttccagacccaataattggcattaaaaaaggcgataaagtaactttacctatttttgctgattctgaaatcaaggtagaagatggaaagtgggtattcacaggctggaaagacggaacagaaatagtagttaatgacaatatattggtggttggtgaatggaagttttgcccaaatatgagtgttatcaataatgtgcctacgatttcagcaaatgatgttacattgaatgtagacgataatttcgacccattgttagacgttagtgcaacggacaaagaagatggcgatattacgctgacaaaggataatattattgcgaatgatgtagatacttctaaagctggtatttatcatgtgacatataaagtaactgacaaaaacggagcttctgctgaaaaaacaattactgttacagtggaacaaaaaactactaacaaaccacaacagccacagaagccaaataagccaaacaatacaacaaagcctgataaacagtccaaaagtccaaaaacaggtgatatgtcaaatataagtttatttgcttttatgtttgctggctcaagtggtgcattagctgttttatttggtaaaaagcgtaaaagaaataaaaatgcttaaaaaatgtatagcaagaaaacaagtagttaattcatgttaaaggacacccaatgaggtgtccttttcaaatttatattatcatatcaaggctcattcaatcgtggtaaaatgaatattttttatgtttcaaaatttcagccggcgattccggctcaggcagcaaagaaaaaattatctgtaaacaaggtatatgattcggcctcagtggtaaaaggaaagacgaagaagaagtatcaggttcggattcagattggaaagatgacttataaggcaaccgcaaataaaaagggaaactacagtgtaaagattccgaaacaggcggcgggcaaaaccttaacggtgaaggcttattttaagaaagggaagaagtggaaagcctatacaaagaaaaaagttgatgttttggcaaaaaccatttcgattaaaaggttttataagtcttcaaagtatataaaaggatatgtaagaccaaagtataaagtaaaagtcgttatgaacggaaagacttacagcaaaagggccagcagcaaaaagggatatttttcagtgaagatgaaaaaagctgctggaaaagcggcggcgacaattaaggtttacaatgcgaaaggaaagttcatcaaatcctataagagaaaagcctatgatgcttcaccaaggcccaagtattatcaggacggaaagccttatacagggaagatgcccggccggtctgatcccattgatttagacgctttcaacaaaaaagtaaacagcgccagaaaatttgaagaccattctatttactccagattcgacataacagacagttattctattgtgtattacgggaatggggtaggtgaaatcggctatactaattattacttagataaaagcaacaatgaagagaagatgtggttctgtgctaagcatggagtgacgctctattatagggtctataagtctgaaaacttgaagaatactccgactcccggaccgtcctataatactgggataataacagaaaagggagaaccagcaaccttaatccctgaacggaaagatccaaaaaagaataccgcttctttaccgatcaaaattgtcggttataaaaatgggaagccagtcatggcatcctactattgtatgaagttaaatgcgggacgttaaaaagaataattaagataataaaaactcatatcatacgcccaacagccgtatgatatgagttttttattgtaaggtttttgccaagtcaaatatgttcttatagattgttgagctgctgctgttcaatctgcagaagcattctgtcatttctggatgtgtatagcggggtgtgctgccttctgatatgctccatcctgcagtggaggcataaatcttctgatgaattataaattgtctctccgcatatcatacagggctttatactgtaaataaattcttccctctcatcatgataaaaatgacggtacatggcctcgtcgacatcacttacttctcttgctgcggattctttccaaagtctgtaattctgaaatgcgtaggacccggcctctctgctgatctggaaaaccgaggagacatcatcctcattccggcactgtgcaaaatgaatggccattctgggagccagaatattgcttgcaaaaaaattggcctgctgttcattataggcacattctctcgaatggcccagcataatatgtcccagttcgtgcatgatggagaaccgaatcctgaaaggggatttgttctcatcataggctatgatccgtttggctccgtaacggaaagcgtcttccgaataattcctgcagtattggtaaagacgttcattgatatcccgtatattttgataagtgaaaatacggtatccatagtgccttaaaatgctgtaacaatcaatcggaaatgactggacttcacagtctctgtaaacatcgagtatcttaacaagtatatcgtgataattcaaatccaccagtcctttataattcagataacatctttataagttctaatttttcctcaatagacatttcttttccgtttcttgcgatcagtgttttcaaatcttcatatgatggttcttttctgctgtcagaggtcaggaattcatcgtcgcagaaatactcagtggtgacaccgagttccttcgaaatctttaataaaacttctatgtctgcctttctgctgtctctcttaatcatcgaataaatagtcgtaggtgccacattgattttcttggccagttcattggcattcatgtgatgttcctgcagtaacagctccaactttgctccaattcccataaaatataccgcctttctaatagaaagaatagcataataaaaaccagaagtaaataaaaaaatatgcaaatgcgtataatcatcttgacatataactcatatgcgtatattatatcaatataagatacgcaaacgagtaatatcaggaggtgagctgttgccatatttaaatttaaaaactgaattaaaaaaaacaaatattacaaacgaagaaattgcacatgtattgaggctgcggacagaagacgtgctggacaaactggaaggctcagggagattcaccatcggagaagcaatgcttctgaaaaaaaggtatttctcccggatgccgctggaatatctgtttgtacatacagcatctaagccgtaacaattttactttttatattaatgagtatagaacatttgtttggaaaaggcaataggcataatagacaaaatttagagaggagtactatgtttgactttcagaccgaaaagggaaaaactgacgcagttatcagcattttgctgcatcactatacaaaggagcagttatcagaattttatggaatttccataagaataatcaatgagtggatcggggcataccggagcagagcggcggctgagatcagagacaggcagatccgctttaacggaagagccgtaaataagatgaggcctcttgtgaccgtttacagaccgacatccggagcaatgtatataggatggaaacacatcagataaagaaaagagggattgatttgacagaaaaggaattgggtcagatgcattatctgaacagggaaattgagaaactgaatgaagaactcagctggatggaatgtaagagtatgataaagtcaccgctgctgacggggatgccgtttgggaccggggtcagcgacaagacagcagactatgcggtgcgaatggaggagatcagagagctgatcgacctgtccattaaaaaactcctgcacacgagggcagagatcgaacggttcctacaggagatcgaagatccggaactcaggcttattatacggcttcgttccatcaataatctcggatggcaggagatcggggaagaacttgggatggacagaagaactgcgtcaaggaagtatcagagattttgtgaggagaaacttgcttaaaatgctgaaaacaggaaggaggaaattatgaaaaaaatcataggccgtgccttaatttttaccgcagtgttcagtattgctgaaaatgctatgccgacgtggtttgctgttgcgatggttataggcggatttatatgtatggatttgtaaaaagacatttgcccacaatgtccgtgattaagctgatatagttatcatggagaataaagggtagagatgtcaagtaaggtagcaaggtctcagtaccctttattcttttttatctatattgtttgagaggatcagctctgggtaagttgcccacaatgtccgtatacgagatgatatagttatcatagagatcatgatctcacaaaaagctatagcaaaaactattttcaggaggtgaaaagtaatcgaagatttaatctgtaaaagactgtcagaatttgctggcttatcggaagtactagcggtttacgacggtaagcctgcggtatttacccgaacagctccaaatgatacagatgaaaagtggcagggagatccgtatcctagaattctggtggacttatctcaggatgaagccatggaacgccagtttgaacaaggtttaaaactgcaggctgttacttcaactgaacaggcagtacaaccagcagatttggaagcagtgattcttgaggcgatagatctttgctttttcagcagacagaatatatctctttgctccagatggaacaggtcagagttctcagaatcacaggatataaaaaccggcagttatatttttgacattatgagatttgaaaaacagcagattcagcagccggacccggtattcactttaaatgaatggctgaaaacgagctatccagaagcaaaaatcattggatatgatgagatgcaggaagtttggaaggcttcgaacgaagcccccgcaatttatggaagactggagagtatcactccgggaaactatggggacacatgggaagtgacatggatgaacgcaggaatccggctacatttgatctccggcagcaaatccaaagccttcctgatcagaaatatcagcgagaaacttctgatgaaagaaaagctaacgatgaatgacggcggacctatgttcatttcaaaggtaaattataatgacacgatgaatcctttaaagaaccggcagtttttcattgaatgtcagtatggagttctccgggaaaaagaagaaaaagatccgattcgaaaaattaatattcaggaggaatgaaatgcggagagaacaaacgatgtatagtgtggaagaatttgcatgcagcccggaagtgctggaagcatctgaagatttaatcagagcagctttttcttatgcaggattagaggaagcaaccgagaaaaaagcaaaaaaaataatcagagaatttaaaaataaggaggtacattaaattatggcaggtacatatcagacaggggaagaaaaaatcagacctggtgtttaccgtaaatatgaaacaccagtgaaagaaacagtggcaggtgcaatgactggagtctttgcaattcctgtaaaagccgactttggaccgcttgacacagttacggttcatacaaaggcggatacagtcagtgcaatgtatggaaacggtggtactgtgaaaggcgccctcaatttatttgaaggaggcgcacagaaggtatatgtttaccgtctgggtacagggggaagcacaggcaaactcgagctgaaggacggagaggatgcagcagttgtttcattggagacaaaatatccatcaccgacagcattttctgttactttaaaaaggaaacttggatttagcatgaggaaagaattttccgtttatgaaggtgcagtattaaaagaaaaaatggaatacgatgttcctgaaagtggaaatgaagttgcgatttttgttgacacagtgaataagaagtcatctatttttaatgctgcaaaaaagacagaagaatcaaaacagcttgcagaaatcgtgcaggagccaatcactgcaggaactgagtctacagtgaccaatgaggattacagcactgcttttgatgcatttgaagcatacaagtggaatattcttgtggcagataccgtggataccggagttcatacgctgatgaaagcatacatggaccgaatcaagaaaaatggttccgttggtgcgtgcgttatcggagaaggtacaaatgtgtcctttgaagacagattgtcacatgcaaaagagtgtaactgtgaatacgttatttatgtgggaagcggatttgtggatatgcagggaaataatgttgacggatatgaagcagtgacgcttcaggctggagttatcggaagtactccgacaaatcagtccattgtgcataaagcgattcctaatgcagtggatgtgatcgaagtactgaaagatgaggagtatattgatgcgattaaccatggtctgcttttactgtctccaagcgaagacggacaggtatggtttgacagcggcgtcaatactctgacagtaccggcggaaaatcaggatgccggatggaagaaagttagaagaaccatgaccagatatgagatctttgaccgaattgaccgcacgattactccgttaatcggacgtgtgaactgtgattccgatgggattgcggcagtcattaaagcggcaaaagacgtattagatgaaatgatcaatgagaagaaactgatggttggagcggatttctttgaagacaaagaaaatcctcatggaaccgatgatgtccgttttgtcattaaagtgacagaccttgacagtcttgagaaggtatatctgaattaccagtttagttttggagcagcagaataggaggaatggaagatgaaagagagaatcgatgtcagaacaatcatgacaggaaatgatggaaagttatttctgcatgtgaacaatgagccggtattactggccgaagtaaaagagtatgaaatcaaggcaaattttgcaaatatcgaatataaaccagtaggggatgtgcagcagtatgcaattccggataaagtaaaattcaccctgaatttcacaggggcagttatccgtgacgaccttacaatcgcaccgctcttaaaaagtatcaaagaaaccggagcaattccgacctatgatttccaggcatctgcggcccgcaatacagacggcaaggagcagagactggtgttaaagaactgtctgcctgacggagacttcgacctgatgactttgaaagcaggcgaagtagttacaagacagcagagtttcgtagtcaatgaagtaccgtactttatcgactggattgacggaagtaaataaggaggaagaataaaatgggaaatgcagcaaaagcagaagaaatggtaaaagtaacaaaagaaaatgaattggatctggtacaggggcttttagaagcagcggatttcagaaacgatgacgatctccagacagaaattcagatcaaaagaaatgataaggtattttttaagttcaaagtgagacctttaagtgaggaagaattggtgaaggcaagaagaaacgcggttgttaaaatgccgaatccttcaaatccaaaattacctccgattgaaaaagatctcagagtggaggagtttaccgcatggaaaatctattatgcaaccgttgacaaagaggaagtatgggacaatccttctgtcatgaaaggactggaagccaaaggttttccggtattaagaggaattgacgtcatcaatacggtcctaagagcgggagaaaaggatgcgatcgatgaccagatcgataagatcagcggtttttatgactccgaaatttccgaagaggaatatgcaaaaaactaattaatgccagtccattggctgcgaagctgcatttcatctggcagaaacagggaagactgccctcggaaatcctcggtctgaatcggggagagagggcattcgtcctggcttcgacaatgctggcaatagaagaagcaaatcaggctgaggaagatgcacgataaatcctccggatttgactttaagctatatcattgaggggttaaagactaaatatagaataataatacagaagaaaagatatcagaggcaatacagaatgttcctgatgtcttttctttttttatacccgcagggtctcaaatacggtgtgccctgtaagagggtatacatttaagagaagggaggaaaatggatggcagaaacattggtcttaaatatgaaaggaaattttacggacagaatctctccgggtgcgggaaaagcttatcgaagccttgagaagctggacaaaaaaatggaaaaaatcatcagacagagcaaccggttaaacggtttaaaaataaatatggaaatttcagccgcagacatggcgacgaagaaaatccagagtattctttctttgggaagacagctggaaagaaaggcgtttactgtcagagttaatgtagacacaaatgtacagaaagcaatcagtacgattggaagtgtttcgggaaatatatcacaaagagcagtctcatcagtagcgccagctatacaatatggagctggacaggcaattggaggacgaagtatttcatctagtagtgcaaaaccaaaagaaagtagtaaacagaaaccttttatagaaaaagtctgggataaaggaaaagcattagccaatgaatacaaagataatgtggtatcgaatattcagcaaagtgctcttgaaaggactataaaggaatacaaagacttgagtatggatgtggcaaaagaagcaggtttaccagagaaagtcaaagcaggagttaccaaaataaagggtggggcatcgaaagtaacatccaaagtaaaatcatggccgatatctaaaacgattggaagaggagtcgaaaaggtggcacaggtagcgcctaaaataaaggaattgccaattactaaaacacttggaaaaggaatgaactttcttaaacaaggagccccaggaattttagattatggaatgtctgcttacaatattgcaacagcaaagccaaaggatagggcaaaaaccgctgtaaaagaaggtggaagtttatttggtggagcagtaggaacagcagcgggaacagcaggagcagcatgggttggaggcaaaataggaggaacgataggtacagttcttggaggacctgtaggtacagtaattggtacaggagcaggactattgttaggtacagcaggttctatgattgggaaatatgcaggcgggaagttatatgatggttaccagaatcttaagaaatctgtcaagaatattaaacttccaaaaccacttgcaaaagctggaaatttcttaaaaaaaagtgcaaagggtattaaaaactttttaacacccaaaacaccgaaaacgccgacaaagccttcggacaaaatagatccttacggtgtcggcaatggcacatattccgattatatgtataatcctggttttaaatacggatatgacaccttgacaaaaggacaaaaaggcggagctaagaagaaaaaggcaggaaaacccataggcaaagacatgggtcagcaacatggcaaaggttttgggaatatgctcaattctacagtgaagcaaacaaagaaaggtcttaactctgtggataaaggagccaaaggtgctaaaaaaggcatgagcggtgtaggaaagagttctaaaaaagcgcagggtaacattaagggcttaggctccagttcaaacggttcccagaagcaggttcagggactgggcgacggttctcaaaatgcggcaggcatgattgaaggaatgggaggatcagcgattggcgttgtagattcacttgtcatgctgtccggagcggcacagatggccgccgcgagccttgcaagcatttctttctttggcctcatgggaggcggaggaatccagaaaaatgcaaacggaagttttgtaggaggcaagacattaagctgggttggtgaagacggacctgaagtgatcatccctctgggcggaaagagaagaaaaagaggcctcgacctctggcatcaggcaggagcaatgctcggcgtatctcagcacgcagacggcggttttgcaggcggaggaactctggctggaagcaacaggtcaggaaagaaaaaagcaccggtcagcgtgtctgtgggaaatattacgattcagctgaaaggcggacaggacggagacggaaagaatatcgatcttctgaaagtcttgaaagaacaaaagaatcaggtgtctgatgaaatctgcagaattttggctgatgcactggaatcagcttatcaaaacattccggccgtacaataagaagaggagggcaaaatggaaattaaaatatcagaggcaggcaattccaagaaatatataaaagtacccttacttccggaagaactgtcttattcaagtacaacgaggtttcaggagtatgaaatattagacctgggggaagtaaaactgcccaggggaagaaacttaagtacggtaagctgggaaggaatcttcccggctgtttcaagggatacgttgtcctttgtaaagaaacagaatacagcacttaacagcccaagctattatatcaattatattcaggactggaagaaaaatcacaagaagctgaatttggaaattcccggtacgacgttaaagaaactgccggtatatatcgaagagtttagttatcatatcgcttctctgggcgattacaattattctatttctttagtggaggcggcagacctttccttaaataagacagtgaaaaaaagggcatcgggtaaaagtacgaaaaaatataaggtcagaacgaataaagagactctgagggacattgcgaaaaagttttatggagacggccaaaaatataagacaatatataaggccaataaatcactgattgataagaaaaatgccagccaaagaaaaaagggaatcaaaacaaaaccatatcagatttatcaaggacaggtccttacaatcccgagtgtttctggttcatccaagaaaaaaacttcggtagttgcactccaaaaagcaattaacaaagataaatatgcaaaattatctgtgaatggaaaactggatgcaaaaacaaaaaatgcaatgaaaaagattgtgatcagaagcggaaaaagaggagaagtcgtaaaatttgttcagggaaaagtgggaaccacaaaagatggtatatgtggttcaaaaaccgtaaaagccattaaagcctaccagagaaagcataaccttaaggtggacggcatggcaggatataacactttgataaaaatggtgagttaggaggtggactatggcaggatcattagagcatccgttatacaggtgtctgataaaaacaaaaaaagcgaattataacgtttcaaatctgctgacgagccttacaacgtcacaaaacaatgaggaactggctcaaagcgtttccattacgattccaaatataaaagataagaacaaatatctatataataacattacagtccgggattcgttatacctgtattgtgataccggaagcggttacaaggaaatattcagaggaatcatatgggagaaagattatacgagtgatgtgacaaaggatctgaatttaatggcatatgaccggctgatctatctgcagaattcacaggataattttttcttttcaaaaggaaaaaatacgaagaccattcttcagacaatttgtaagcgatggggaatcaaattaaactttcagtataaaagtatcaaacataagaggaagatcatcagggaagagactatttctgatgccatactttcgattttggatgaagtgaagaaaaagacaggaacgaaatatgtgatctactgtgaaaaaggagttttgaccatacggaagagggcatacaacaagaagatttatacattaaatcaaaaggactccgcgttgtcacagaatacaagagttaccatggatggaatggtgacaaaggtggcgatttaccgggaacaggagtcagagaaaaaggagcttccgccaaaaaaggtgacagtagtcaaaggaaatacatcccgttatggtacacttcagcaaattattgtgagagactcagatgataagaagtctgcccatgcaaagaaagaagcaaaagaaattttgaaagaacaagggaaaccaatatatgaacgtactcttgaagcagtagataatccatatattaaaaagggccacaggattaaaagcagtgcaggagctctggaaggttattataccgttatcggaatcgaacatgactgcttcaatggaacaatgagcttggaggtggagacctgatggcagtaaaagggaatataagactggcggctattttacagaagagaatgggaaaaatcaaggaggcaggatttatccccaatgcggagataggaacgtataaaaataagggattggtgctggatagctttcctgataatgtcatcggaaatgatgaacttgttctgtgcagtaccttgaaaggaaaacttgcacagtcagcaggcaaaagcatcagagtattggtcgtatgggcagatgaaacgcctgtggtagtagatcaggtagaaatggtggatgaatcataatttagggaggtgatgatatggccaatctttttcctgaggatatggaagatgaggatttagaattagaacagttggaagaacaaatagatgaggaaccggtgggttacaaaccaagcgtctgttttgatgacggattagaagactttaaaagggacggatctatgaaactggtagaatgcagcggtctggaggcatggatacagtggtgcaaaaaagttattcagacaaaaagatatgtatgtcaggcatacagcgatgatatcggaattgatattgaacaggcttttcaggcagggtccagagaagaagcagaaagtatattggaaaatgaaatcgtggaggccttggaagcagatccgtatggaaggactgagtttgtacagtctgtcacatttcagtggaaaaatcctgattcagtagaagtactttgtaaagtcattggtattgattcaaatgaagcagaactgcaggcggtaattgagagatagtaaggaggaagtatatggatgaagaaattttagagaatttagaggaagaattagaagatgatgattttcagatccctaagtttcttgaggaatccagtgaggaagaggtccataaaagaatgctggataacctgcagaaggatctggatacatcagaaggcgggtatgtttatgatttaaccaaaccgacagccatcgaagtttcccgaatgaaagaatttgaactggtagaggccctcaaattgatctggccgagatttgctgagggaatttatttggattatcatgcggaaacaagaggattagaaagaaaagaagcaatcaatgcaaaaggaattcttcgtatcgaaggacaggccggcacgctcatacctgagggtgctgtttttacgacagaaagtataaatgatgaacctgagaaagagtatgagactttaatggaagtccagattgcagaagaaggttttgtggatgtagagattcagagtgtggaggccggattatctggaaacagtggtgagaatacagtcattctgcagggagacatcatcgaaggaatcaacacggttacaaatcctgctccgattgcaggcggtttggaagcagaggaagatgagagcctgagagaaaggatcatggaatatgaccagacacaaggggattcgttcgtgggaaatatgaacgactataaacgctgggctttatctgtggaagggaccgggaatgccaggattgtcagcccggaagacggaagcggaatcgtaaccatctatttgacaagttcagatggaaaacctgcgacaaaggacttatgtctggaagttcagaattatatcatgaggccggataatccggatgaacggctggcgcctgtcaactccatagtaaatgtagaaccagcggcagaactttctattgcggtgaaagcggttgtccagctaaaagataatacaatggaaaacgtcagagaaacatttataaaaagcatgcaggaatacttaacaacagcggagactgacggggaaatcagatatacgaagatagctaatattttgggaagtacagccggggtttatgatttcagcaatcttactgtaaattccgggcaggtgaatattccgattgaaggcggaaagatcccggtattagatcttcaaaatctggagctgacagaataggaggtagttatggcagtacatacaaaattgatggaagaagttctgaccagtgaagaagctcagaaaatcattgattttgtcagccccgtttacgggaattcctatgtcgctcttaaactttttcagagcatcgggctggcattagatgagatcaacagttttccggatgattttatagatcagatcatgatacagactgcaacatggtctctggattactgggaagaacagtacagactttatccggaacccggatggagcatagaacagcgcagaaaaaatctgctggaaaatttgggacaccggtttaacaatcccaaaaaaattgaaaatgtacttgaagtattgacaggacataatgttcagattgaagagaatatcgagaaaaacaaatttcaggtgtttgtcatgggatatgtcagagatctgaagcctgtcacggactttgtggataaagtaaaaccggcgcatcttagctataaaatcaagatgtcagaattaattgaggcagatgtgtggatttatactggaatctgcctttctgaacatgaattttacagaatcgaggtggaataaagtgaatatatggaagtcagcagttattacaaaaaaagggcaggctctgcaggataagctgattgcagggcagacattacaatttacaaaagtacagaccgggactggagaagcagtcattactcagcttgaagaccagactgatctgatcggtcccaatcagcttattacatttcagcagatagaagaaatagacggacatatcgacatttctgtgctgttggaaaataccaagctagtgaaaggatatgaactctggcaggtcggaatttttgctcaggatccggatgaaggagaaattttatattgtctggcacaggcatcagaggcaaagaagattcctgcggcatcggagaatccagggttttcggttacatggaaatttcatttaaagaattccggtaaagcagaaacggatatttcgataactcctgccggattggtcgatttccggcattttgatgagagaaagaacgaagtaaatcaaagatttcaggatgtagagacaaaaatgggaagtctggacaacttaaagaccagtgaaaaacagagtcttgtcttagcagtcaatgaactgaaaacaggagtggaccgcttaaaccaaacatttctcgaaaaaacatatcctatcggaagtgtttatacatctgttagatatcaaaatccttcccagctttttggaggtgtctggcaggaatttgccaaagggcaggtattagtaggagtaaacaccacagatccgttatttaataccgtagaaaaatcgggcggaagcaaaaactctgtagtagttgcacataaccacagtgtaaatggattgtcagtcagtcctgtaggagaccatacacatacaattaatagtgcaggaaaccacagacacggagtatatgctgatgttgactgtatcacttcagccacaggggccagggatctggcctgccccgaaaaaaataaggataccctatgggaatccgcaacaccgtatgcaggaaatcattcacattctatgtctggtaaaggaggacataatcatacggtaccagcccattccacaaacagcagcggtggagacggcacaaacaaaaatctgcagccatatttaacagtatattattggaaaagaacagggtgagacgagaagtgatcgaacaaattttagcagtatgcggcggcatcagcatcattggaggtgccggtgccgtcatttataaaatcatttatcccgctctgcagttcagccaaagggtggaacagctggaggagcactcggaaaatgactatcagcggctgaaaggactggaggagatgcagaaacaacagtccaaatgcttagccgcaatgctgaaccatcagataacaggaaatgggatagaaaatatgaagaaaataagagatgagcttttggagagcattattgaaaaataaaaggggggtcaaacagatggatttgagctttattacggaatattatatgccgatggtcctgacagcatctttgatcattggttatgtggtgaaaaaatcgctggattttattcctaacaagtacataccattgattcttgccgtcagcggtgcggtgcttggctgtatcgtaaacaagacggttgcactggagcctgtggtttatggagcattttccggacttgccagtacagggcttcaccaggcatttacgagattagtggagggggaataagatggcagtttacaatatcagtgccgggcataatccgtccgggaaggtggcctgcggtgcagtcggacttttagatgagtcaagagaaaacaggctggttgttaaagaaatcatcagtctgttgagatctgccgggcataaagtatacgattgtacttgcagcaacggaaagagccagggagatgttctgaaaaagattgttgccaaatgtaataaaagagaagtttcactggatgtctctattcactttaattcagggagaaacgactgttccggcgacgggaaaatcgccggtgcagaggtctggtgtacggcatcctccggaatcaaaaagcgtgcagcagaaaaaattttaaaaaatatgaaaaaacttggttttacaaacagaggaatcaagacaacaggcggactttattacctaaatcatacaattaataaagcaattttggtggaagtttgttttgtggacgacaaagacgattgcgaactgtacaaaaaagctgggtacaaagaagtggccagggcgatcgctgaaggaattgcaggggaagaaataaagcaggggaaaactagtaaatatactgccgtgaaaaaaacttcgtcaaaagaggcggtccgctggcttcagggaaagctgaatcaatgctatacagggacactcccaaaactcgcagaggacggtatttggggtccgaaaactcaggaaatgctggaagcatactgggaacagctgaattggagaaaaggaagttatgcaggcggaaaaacctgtaaagcactgtataaaaacaggaaaaaatgacatatctgtgctataatttagttacaacaatacgatgattcggagggagagagatgatttgtcagaattgtggtaaagagaacagggaggatgctctgtactgtgaatggtgcggcgtaaagctggaggttccaaatgaaaaggatcagcagtttcgtttgtttctgagcaggaaagagcggaattccggtatcttctggagtgttgtaacacttttctatgcatggttagcattaagttattggtttgtctggtttggagccatttataatgtagtcgttattattttaaggtttgtgcaggcggaaaaagtaaaaaatccatctgtagatctggtgcagtcttatcagaataagaagaaacttcttatcgtaacgctcattgtaaatgtattaattggttggtttccggtggctctcgcaggttattggaacgataagaccaagataaactatgtgatgaaaaatcctgagtttgtaaaacagtgacaggaaaacaaaaagaacaggaaacaaaatcaaatttttgcttcctgttcttttttatttgaattggttttcaacataattccgcatttcctgccgggtcttcatctgtttggcaccgtcgatgacctgacgctgttggtcagaagtcagcgaagaaaatgcagacagggcattttcgtgctgtgccagttccatggtaaatccgattggaatatcttcatttctcatagtcatcacctcagaaatagtatgaccggaatcagacaaaaaatacggaaataacattctatgcattgcagtcagtcgtaatcgtcataatcatcatcgtcgtcccattccacataaacgtggacgtaggcttttaccttcggattatctttgcaagtcagcgtgatggttgctctgccaggttttttgccatagatataacctttggaattgacagtcgcaacttttttgttgctggaagaaaacgttaccttcttgtttgtggcagtccggggataaaccttgtattcgatgtcttcccaatcatgaacatctacatcggtgtagcggtcttccacccagattctggttggctttgtatacttcttttttgcttttttctttaccgtgatcgtacatgtctttttcttctttgtaccacggatacggcaggtgattttaacttttccagttttcactgcttttacagtgatgtcatcatctctgcggtctctgcttacgatcttcacaatttttttgttgctggtagaccagatcagctggtcatcgtcgtagtcagaagggcgcgcgtaggcttccagctcaaatttttgtcctacccgcagggtcttcttagagtaattcagccttcttatagaggtcggttttggatcatcttcgtcggcatggatgctgagcggtgatataatgaccgtcagacttaacaatgctgccagtacagcaggcagtaattttttaattttcatattttcctcccatgaatctttaatcgtcatattctacaattacatatacgtaagcttttacctttggattagctttacatgtcagtgtaatctttgttctgcccggacggactcctctcacatcaccgcgggagtttacggttgctattcttttattgccggaacggaaggttacttttttgtttgtagctttttttggatataccttataatcaatatcctctgtatcatttacgtctacatccatccgtttatcttccagtttgatctttgttggttttatgtatttctttttcgcttttttctttaccgttatggtgcaggttttctttttctttgttccccggatgcggcaggtaatctttacttttccggttttcatggcttttaatgtaatatcatcgtctctgcggtctttgctgatgatttttacgatttttttgttgccggtagaccagatgagctggtcgtcatcgtaatcatatggccttgcataagccttcaattcaaacttctgcccgactctgacagtcctctttttatagttgagttttcggatagaagtgggtttcgggtcgtcgctgtctgcatgaattactgcaggggacagggaaagggaaagtcccatcatgaatcccatgaacattaacaagatttttttgactttcatggcttacctccttcgtcataaaatacgtttgcagtgacaatatcttccggcctgccccgcattctgacaggaaacaggcctgagatattgaaaataaaattcagcggttaatcatcgatgccaaatttgttttctaaagtatcttctgcaaaatcaagtttgtcttccagagcgtcaatcctgcgttcgatttctttatattttgcagctgagagttttccggtatcatactgatgctcataatcgtcatccagagtatccagttcatggtcgatggcatccagttcctttttcaaactataaaatttatcctgatttttggaaacatcggagacgggttttgctgcctggattttttttgtaatctgtgagatttttgtctcatatttgctgaagtcaggtgtgtcggaagcggtcgcctgagtctctgttgacttttctgtggcattttcggttccctctgctgtcgtggcaatgtcctgtgtggtagttgcttcggcctggtctttcggtgtgctttggcatcctgcaagtaagaatacaaatgctccgcaggctaatatggctgttattttatttttcataatgaaattctcctttcgtatctttgataactttattatagttcccttttattaaaataaaattaaagacttcattaattttaaaatgttctatgtatcttttttacattgagaaaaatagaaatatatgttattattatttatataaaagctggttatatgacagcaaatagcattcagataaatttgacggcatagtagagagaactaatgccgtttttgttttttgagattatgagagagggaatgaggattatgaaagaaaaaaagtcaggagaagtgtgtggatttacaagccgtataagaattgctgtacaagtttttacgttgtttatggcagtgatattagcctgtacatacatagagatttatggtgcaggattggtgcctgcctacgcgtcaccggcagttgttaaacctgaagagggagatggtactgccgatcatccctataagattggtacagcccaagaactctattggtttgcagaactggtaaacagtgaaaaggataaggctgcttgtgctgtattaacaaaagacatcgaagtaaatacgggggatgtcagcggatgtgatggaaagaaagaagaaggatggcaggaatggactcctataggagacttttcgtctggaggatatgaaggcacatttgatggacagggacacacgataagcgggctctatttcaatgacaatgaaaaaagggcaggattatttgcacgattaatcggagcagaaaaagatgctcctgcccgtgtaagaaatgttggtattgtaaattcctatataaacggggaagatgtaggtggaattgcaggacaagcccagtatgcagagatagaccagtgctttaatacttccatgattacgagtgataataaagtcacctgttgtctgggcggcattgtaggagaaagttttgacacatatattcataattgttttaatactgggactgtaataggaaagaatgctatgtttagttcggtggcaggcatttgcgggtatagtatgtcttcgtcaggcaaactaaataactgctattatcaggcagagaagattgacagggcttacaatacaggcaatcaacccattgtgacaaagactgaaggagtatcagccgaggcattcgcagcaggaaaagttacctaccttttgaatgccaacgatgaggcagcttcagatgtatgggtccagaatgttgacaatggaaacactccttatgggaaaataccggaatttaaaaatgccagcaaggctgctgctgtttatcaggtaaccgcatataattgtgacaagacggcgcctttgaaaggagtcgatgcttacagcaataatgcggcggaacatgtggctactcatatttataacagcagcacgggaatatgcagcggatgcggaaaaaatcataaagagattgcgggatcccattcatatgatatcaatcataagtgtacggtatgtggatatgtttgtcctcacacttatgacgcagaagctcaagatggtatttgcatagagtgcgggtatggacatgaacatgaagtgaccgattttaatgaggaacatgtctgcggagtctgtggatatttttgcaaagatcataagtataataaaggcacctgttctacgtgtggatatgaacatccggaacatacctacgaaaaaggagcctgtatggtctgtgggtttgaacatcaggagcatcagtttgaggagggtgtctgtataatctgcggatacaattgtccgcacaaatatgctgatggattttgtacaatttgtggtgtggcatgtacagaccatcattatgtgaatggtttctgtaatgtctgtaaaggatgtgagtcagcaacagacactgataatgacggaatacttgagattgataactcgggaaaactgtattggtttgcggagcaggtgaatgcaggaagttcaggtatgaaggctgagttgacgagagatattgttgtcaacccaaatatcctaaaggaagatggttctctggttgatggcgcaaatgatctgcggaaatggactccaatcggtacgaaggagaaaaactatacaggagaattcgacggaaacgggcatacaatttccggattatattgtaccttcagatcggactattccggattatttggatatatttcaaacgcgacaataaaaaatataggagtaaaagattcttggttttatggaaaatattacacaggaagtatttgtgcatatagtactaataattctttgattggaaagtgttttaacgatggaagcactgtaatcggcacatatgggtatattggaggaatcagcggctattcaagtcagacggatatacggaattgttataatacaggagacatctcagctacagagtctcttggatgtaatgtgggaggtatctgcggagggttcagccattacgatagcggttctgttgagaattgttccaataccggaaaagtttcatttgctaaaataactggagtaccgaaatattatattgggggtatttgcggatttacttataatcaagatttcaaaaattgttattatctcgatgatgaagaatcggatgaacttgagggaacaacacataagaccagagaacagttttcatcaggagaagtcacatggcttctagacacatcggatggaactgtaaatcatacaaatggctggaaacaaaacttagagacgaaagaaccagggtttgataaacaaggcttgttaatataccgtttatcttatcagaaagaggatgatcccaagagatacatagaatattttgatgactcatatgatctgaaaccattaaatttatcaggtgattgggtatatgaaggtgatactctagatcagaaaaacaaagacggagattcatacattgatctaacggcaacaatctattctgacctcacaataaagcagctggttcctattcgtattaagtctgatctgccgacagatattgcaggaacttatcccagagagttttcaacaatttatctgtgtgattatgtagaaaatcttgaaaatgtagggggtattaaatcctgtgaggttacagaggggacggttcctcctggtttaaaattgtcagaaagcagggaagacgtagggaagatcatgggcttttgtgatgaggccggtacgtatcctgttacctttacactgacaggaaaatatgatcaaaaaaaagaactaaagctggtttttaaaattgcaaaggcagaaggcgagcttaagtttaaaaattattatcaaaatcatacttatgatggggggcctcttgaagaaccaacaaacgataatgcggaaactttcacgaacagggaaggggagttttcgcgtagatggttttcaggttataatgacgggaagatcgaaggactggaagaattacaaagtgcgcctaaagatgtaggaatttatacagtgcagataacaaaaggagagacaaaaaatcgcaaagcagtttctgcaacgatgaaaatagaaattaagcaggcatatatccatcattttctggaagaacttgaaataacgccatataaaggggtatacgatggaaaatcgcatgatgcagtaaaaatagccggcgtgtctgacgatatgaaagtccaatatagcttaaatgattcagcgtttagtgaagaaatgcctcaacttactgataaaggttcttataaaatcgcaatacaaatttcaggagataatttttataacaaatatatttattatgataaagatagaaatccatggatttctgcagggatcacggaaaaagaattgacttctgaaatggtacaggagattcctggccagatttatacgggaaatccaattacactggaagatgatttatctataatagatgaagaccataaactcattttagggaaggattatgagataacaggatattctgagaatacatttgctggctctgctgcctgggtagagattcagggaaagaataattatactggcattgtaacccagcctttcacgatagtaaaggcagacagagcaccaaatatcccggatgaagagataacagtggattatgaagttgaatctgtgtctgaggttgacctgccggaagattgggaatggacggaagaatcttttgataaagaacttcatgtcggtgaaacgactgcgacagcagaatacatgggagaagataaaggaaactataaagttgaatctgtcgagattcagattacaaggcaggaatgtcctcacgagcatacagagttggtgcataagagtaaacctacttatacagaagacgggtatacaggagatattcagtgtatcatttgtaacgagatcattgagtatggggaagtgattccaagactggacccgacggatattagcggtgctaatgtatatggtatacacgatttagtttatacagggaaagcacagacccttcatctggaagtagttataaagggggaaaccttaaagagagaacaggactataccattgattatgaggacaatacaaaagtaggaaaagcaactgtgagaatcacaggaaccaatggatacacgggaacaattataaaaagttttttgattacaaaagcggagaaagcacccaatatgcctgccgggttcctgaatgtgagttacagcaatgaaacggtgtctgatattttgctgccggaagattgggaatggaaggagtcggataagagaaaagaactcatagccggggagacagttaccgctgcagcagaatatgtgggaactgataaagactgttatgaatccaccaatgtaatgatgcgtattacgaggcttgcatgtgcccataaaaatacggaagtaacaggcaaaacagaagcaagctatgcggcagaaggatatagcggagatgtttattgtaagatatgcggaagaattgtggaaaaggggaggagcattgaaagactgaaaccaagaagtattgccggagcatctgtatatggtatcaggacattaaactatacagggaaaccacagactttacccataaaagtgattgtttcaggaaaaactttatccagggatattgattatacgttgagctacaaaaataatactaagattgggacggcagaggtatggattaagggcaaaaacatgtattccggaagtatcataaaaaaatttaagatatccgcactaaaaggtaggatttactctgtaggaagcatgaaatatcaggttataagttcggcgggaacagttaaattgattggcagttcgagatctaaaacatccttaaaaacgcttacaatttcgagcagtgttaaaattggcggaaagaattttcgtattacagccattggggacaaagcgtttaaaggatataaaaagcttaagaaagttactgttggaaacaatatagtgtcaattggaaaagaaagtttcagcggatgtaaaagcttaaagtatatttatattaaaactgctaagcttaaaaccatggggaaaaacgccataaaaagtataaataaaaagtctgttataaaggttccgcgaaaacagttgaagaagtacaaaaagctgatgaaaagcagaaccggttttaagaagacaatgaaaataagaaaataactttaaacaggaggtgtaaaagatacaggtgttcaattcatgagcacctgtattttccatgtaagtcagtagaattctcaggtaaattaaattaaaacgttttcataaaattacatttatattataatagttccatatggaggtatgacatgcgcctgttaattgtggaagacgaagaggatttgagaagcatcttaaaaaagaaactgatgaaagagcattacactgcagatgactgcggaaatggcctggatgcactggattatatcaatatggcggattatgacggcatcatcctggatattatgctgcctgggattgacggactggaactgctgaaaaagatccgggaggagggcaatgacacaccggtattgtttctgactgcaagagacggcattgaagaccgcgtgaagggtctggaccttggagcggatgactaccttgtaaaacctttttcatttgaagaacttatggccagggtgcgggttatgatgcggaggaaaccggcactggtttctaaccggctgacgattggtgatctggttctggactgtgaatcaaaggaagttacccgtgcagataaaaagatatctctttccagcaaggaatttatggtccttgaatatatgctgagaaatcaaaatattgtgctgtccagggaacagattgagcagcatgcatggaattatgattttgagggcggatctaatgttgtggatgtctacatccgttatctgaggaaaaagattgacgaaggatttgggtgtaagctgatccacacggtgagaggcgttggatacgtcctgaggaaagaagaatgagaagattttcgattaaaaaaagagtaaccctttggtacacaggtatgatcgctgtcgtgctggcagcagtatttgcaggggttttcatatttatcaatcagctggaactgtccaagacagaggaagatctacagggaatggtggccgattttgctgacgagatagagttccagaacggaacctattatctggacccggaggtagactattatgacgacggtgtcatgttttgtatctatgatcaggaaggcaggctgctgcacggcagtatgcctgtggaatttcccaaagagacgaagcttcagtctcatgaagtccgaaacataaagcagggaagcaagcagtggatgatctatgacgccgcttaccagtacgggaccggaaaggccatctggatcagaggaatcgtctctattcacggcatggaacagatcatgcatatggttctgctggcctttttagctgtatatccgctcctgattctggccattgggctgatcggatacatgatgacgaaaaaagccctgaaaccggtggatgatatttgtactaccgcaggggagatcagcagcggtgcggatttgtcaaagcgcctcccggaaccgaaatcggaagatgaaatgcgtcagctgacttgtacgttcaatgaaatgtttgaccgtctggaggcatcgtttgaggacgaaaaacagtttacgtccgatgtttcccatgaactgaggactccggtttctgtgattatagcccagtgtgaatatgccctggaggaagatacactcagtgaagaacagaaacatgagattcagattgttctccggcaggctaagaaaatgtcggatcttatctcacagcttttgatgattgcccggtgcgagagaggaaaagagaatttccagtttgagcctgtggatatgagtatgctggcagaaatgaccttggaggaactgtcacagagagccggtgaaaaaaggattcatctgctgagtgagatcgagcccggactcacagccagaggagaccagatgcttctgaccaggatgctgatcaatctggtggagaactccattgactatggaaagagaaatgggatcgtgaaggtatctctgttcaaaaaagacgggaagattcggggaatcgtgaaggatgacgggcagggcatcggagcggaacatttagacaaaatctggaaccgtttttaccgtgcagacaggagcaggaacagccaaaaccaagtcaggggtaccggtctgggcctgtctatggtaagatggattgtcaggatacatgaaggacagatttgggtaaaaagcaaggaaggagaaggttcagaattcatatttgaattaaaggaaatgtagttatggagaagagagaaaagttttcatcgaggattggatttatcttaatatcggcaggatgcgccatagggatcgggaatgtgtggaggtttccgtttgtaaccgggcagtacggaggagccgccttcgtactggtatatttgtttttcttatttgcgctgggtctgccgatcatggtcatggagttttcggtggggcgtgccagccagaaaagtattgcaacttcattccagacattggagcctgaagggacaaaatggcattggtacagttacttcggaatggcgggaaactatcttttgatgatgttttatacgaccgtggcaggatggatgatcagctatttcttcaagatgctgaaaggtgattttgtgggaaaaaatccgaaacaggttgaggccgtgttcggagaactgctgtcaaaaccggaagtgctgatcttctggatgctggtcgttattgttgtcggatttttgatctgttcgctggggcttcaaaacggggtggaaaagattactacggtcatgatgtcctgcctgtttttagtcatccttgtgctggtcataaggtccgtcacacttccgggagcatcaaaaggactgtctttttatttagtgccggattttcaggccatgaaagagcaggggattatgaaagtagtctctgcggcgatgggacaggcgttcttcacactgagtcttgggattggagccatcgcaatcttcggaagctatattgaccggtcataccgtctgacaggagaagctgtcagcgttgcggtattagatacacttgtagctcttatgtcaggactgattatctttccggcctgctttgctttcggagtgcggccggacagcggaccgaacctggtatttatcacactgccgaatgtatttaacgagatgccgggtgccaggatatggggagccctgttcttcctgtttatgtcctttgcggcgctgtcgaccattatcgcagtattccagaacattatttctttcgcacaggatctgtggggatggacgattaagaaagccagtatttttaacgggatactgatcaccatattgtcgcttccatgtgcactgggctttaatgtctggagtcacatcatgccgtttggggcgaacagtacgattcaggatctggaggattttattgtgagcaacaatattcttccactggggtctttagtgtatcttctgttctgtgtgacaaaatacggctggggatggaagaacttcagtgaagaggccaatgcgggaaaaggaattaaatatccggaatggacgagaaaatatgttacatttattcttccgctgatcgttatttttatatttatacagggttacattgacaaatttaaataaaaaggcagaatatcaaaagggtcttggaattatccaaggccctttctctttaatgaagctataaattgatgacgctgcctgttttcatatagcgcactctttctttcattgtttttttcaatatgcggaaagcgggaatacccgtgcagtggccggtatacacacaggagataccccgattgagaagctgtcttcccagcgcttggatgccttccggccgaccgctcatactgcccggaccccggagtcccatggtgtgaaaaccgccgaatacataagagactttcttacccgttgccttcagggcatgattgacttcatcaacgatagaaacaacacccgcatggcagcagctgttgaacagcacaagatcatgttcgcgttcaaagacgagactctgttcgtggctgaaatcatcaggtctgaaactgttttttgccttaatatacatgtgcccgctgcggcccctttccgaaagcccgggaatgttgtgtgaaactgtccagacaccgggctctgtctctgttgtgccggacacaaatctaaggcggcttcgatatttttccaggagacccttcggtactccgatgtattgcctgtagagcaggaacttagaataacaattttctctgacagtattttgaagataaagcaccgcttttgaattctcggaaaagaattcacggtatccgccggagtgatcataatgggcgtgagagagaaaggccgcatccacatcggaaaggcggatgccaagccggtgcgcattttctgcatactgtccagaggcgccggtgtccagaagataattttttcctttgtattcgatatgtacagccagtccgtgctctcggcacagagagtccggagcctgattctcaatgagagtcgtaattttcatatgatcttcctcctgaaacgatgattaattgtctgttttttcctttggtatcgctacatttaagacgatagcaaccagagctgcgggaacgatcccggagccgccgaagatcagctgaaccgcctgaggaagatttgccagggcctgggagttggcgccgagcccatagccgagtcctaatgccacagatacgatggttacaatccggttgcttactccatccttggtgatcagctggattccgctgactacgatggaagcgaacatcataaccgcagctccgccgagaacggattgcggcatgatagaaactaaagcggcaagtttcggaaacagtccgcagatcacgaggaagcctgcgcccatggcgatagagtataaattgacaacctttgtcattcccacaagtcctacattttggctgaaggatgtattcggaagcactccgaagacagaagcgaaggaagatcccagaccgtcacagattacaccgccggagagctctttatcagtagcttctctggacaatccgccctcagtgatgccggaaatgtcccctatcgtctcgacagaagtcacgatgaacataatggcgatcggtatgatagctttcaggtcaaatacgattttgacgggcatgagtttcggaagagagaaccagccggcatcggctactttatcccagtttaaaacccaggaagctgtctgcacggcaccctctgcgtttgtataagtagtgggcagaaatatgcccatgacagcgcagagtatgtagcccacgataacaccgatcaaaatagaggaactgctggtgaccccttttgtgaaatgctttaagacaacgatcacgatcagcaccacggctcccacaaaaaggttcgggagagaaccgaaatcccctgctccggatccgcctccaaaagagttgattcccacagagatcagggacaggccgatagccatgaccacagtaccggtgaccacagacggaaagaacctcctgaggggctttaagaaaaatcccagaactccttcaaacaggccgccaataatgcttgctcccagaatggctccgtatgcggctactccgccgcccatagaggctgccactccggaacatactccgataaagccggagctggtgcccatgacgactggaaggcgggcgcccaccggcccgatggtgaacagctgtacaaaggttacgagtccggccaccagcatggcattctgtaaaatagatacctgaagagggctgcctgcaccgatgccgcaggcaccggcgatcaggatgatcggagtcagattgcctgcaaacattgccaggacatgctgcagtcctaaaaggacggcttgagggagggggatttttccctccagatcatgaggggacgtaaatgtttggtttttcatattaatctccttttttatattaaataatgaagaaaaccggagatcaatgtactcttccctgagagaattttctccgatttatctatttaaagtagcacagcagacgaaaaatgtcaaaaaagacgctgaatagaagaaaaagctataaaaaataaacggggaaaatataagataaacggtaatgaaatagggaaaataaggatgaggaaaagttttcatgacaataaaacagccatttattacattgacgcacacaaatctgaaatatgatgtataataaatctaaattcaaggttccctcccttgaattagagataaccctctctcacacattaagtgtattttggtataatgaaaggccttccatcgccaggtggaaggcctttcattttgtatacgctcatacgccaaagttttcaattcttactcaagagcttttgcaacttcataaagcttcatcccattagatgctttgatcagcaccacatcatgttcttttaaataatcctttaaataagatatcagctcatcattggaggaaaaccatttcgtttttagtgagagattctttttttgtgcagcttctgcatattctttggaaagggttccggtgatgtacagatccgtaatatctgccgtgcccaaaaattcgccgacttccctgtggtaatccggagagtccggtcccagctccagcatatcggacagaaccgcgacttttcttccgctgtcctgataatcggacaagattttaagacctgctttcatggaatcggggctggcattgtaggcgtcatcaatgaccgtgtacccgtgtattttaaggatattctggcgctgtccggagaatgtggcaagctgccgtttgatcgtttccatcgggacatcatacgcaaggccaagtgcgattgcggcaagggcgttagagacattgtgattcccaagaacatttaaaatgaccggttccctcatatcttcatgcacgaaagtaaaatgggtctgaccattgatctcttttgaatcctccgcacgataggagcagtcttttgaaaatccaaagaattcataaggatgtgtcacataaccgatgtgttttcggatcatatcattgtcgccgttcaaatacagcacgccgttttcaggcagaccgttctggatatccagtttttcccggcagatattgtcccggcttcccatctgctcgatgtgggagacaccaacatttgtgactaccgcagcgtttgggcggatgatttctccgaggattgtaatctgtcccggttcactcatgcccatttccagcaccccgatctgatctctggaagtgagacggtccagagtcagaggcacgcccacctgactgttctggtttccgacagtttcaaatacccggtattttcctttcagtacatgggcgatcatttcccgcgtcgtagtttttccgacacttccggtaatgccgatgatgggcagtgacatcttgtttctataaaaagacgcgatctgctgcatggcttttaaggtgtccggcacttttataataggatgagggccttccgcctgctcgtgttcctgggtcagagaagctcccccgtcctttagggcactttctacaaacttatgtgcgtttacccgctcaccgacgatcggtacgaataatgtatgaggccctacatctctggaatcagtgctgagacgattgattggcatagaggcatcgccgcataagagagtgccgccggttgctgctaaaatatcctgaatggtcatatgttccataatcttactcctttaacttcttatcttttctttagcattatagcacaggatacggatttgtggtaaaatctaatctgtatagaaatgttgttcgatcaatttaaggaggacactgttatgagaaagaaaaaactgatatttgccggacttttggctgtggcagccgccgcgggactggccggatgcagtaaagatacgaaacaggcagaaaagaccactgcagagacagcagccgggaaggaaaacacgaccaaaaagaaaacggcgtcagggaaaaaatccgatgccgcagagacagattccaagaaaacggttgtaagagagtgcacgatttatgctccggatgacaacgtggagaccctgattaacggaaaggtcaagattgaggacgtgacggccgggaagctgctgaaagagatgattaagatggggactctggaggaagggaccaggatcaattcctttcagattaagaagcagaccgcctatatcgacttcaataaagcatttgagaagacactgcgtaagatgggaagttccggcgaggtgctgacggtacaggcagtgacaaaaaccatctgtgagaatcttgatgctaaggcaatgaagtttacggtagagggaaaagtcctggaaaccggacataatatttacgatgagccccagaggccgggcgaagaataagtacaggagagaattccatgagttttacacacttacatgttcatacagaatacagtcttctggacggctccagtaagatcaaggagcttgtgcaccataccaaggaactggggatggacagcattgctatcacagaccacggcgtcatgtacggggtcattgatttttataaggctgcaaaggcagaaggaattaaacccattctcggatgtgagatctatgtgacgccaggatcaagatttgaaaaagaggccagacagggcagcagcaattactttcatctggtgcttctggcagaaaatgaccgtggatatcacaatctgatgaagatcgtatccagaggatttacggaaggattttactataagccgcgggtggattatgaagtgctcgaacgttacagcgagggacttattgcgctgagcgcctgcctgggaggagagattccgacttacatcagggaaggagattatgaaaaggcgaaagagacggccttgagatttgagaggatttatggaaaaggcaatttctttttggaactgcaggatcacgggatcagtgagcagacaacggtaaattctgcgctgatcaagatgtcaaaggagaccggaatcgaactggtggcaaccaatgatatccactatacatttgcggaggacgtggaaccccatgatattctgctctgtatccagacaggaaaaaaggtcgctgatgaggacagaatgagatatgaaggcggacagtattatctcaagtccccggaagaaatggagcggctttttccgtatgccaggcaggcagtggaaaacaccggaaagatcgccgagcggtgcaatgttgagatcatcttcggtgagcagaaggtgccgaaatttgatgtgccggaaggtgatacatcgacttcttatttaagaaagctctgtgaagagggcatctgccgccgctatgacgatgtgactgaagaactcagggagcgcctggaatttgagctgaaaaccattgaaaatatgggatatgtggattactttctcatcgtttgggattttattcactatgccaaagaacatggtattgccgtaggtcccggccgcgggtccgcagccggaagtattgtgtcttactgtctggagatcacggacatcgagccgatcaaatatcagctcctgttcgagagattcctgaatccggaacgtgtttccatgccggatattgatatcgatttctgttatgagcgaagacaggaagtcatagactatgtggttgaaaagtacggcaaggataaggttgttcagatcattacattcggaactatggcagcgagggccgtgatccgtgatgtgggcagggttcttgatattccatatgcaaaggtagacgggattgcaaagatggtgcccaatgaactcaatatcaccatcgagggggcactgaaaaaaagtcctgacctgaagaaggcatatgcggaagacgaggagaccaagtatctgattgacatgtccaggaggctggaaggcctgccgagacacgcctccatgcatgcagcaggcgtggtgatcggcaaagactccatcgacgaatttgtgcctttggcgaaaggagcggatgacgccgtaacgacccagtttacgatgacaaccattgaggaactgggactattgaaaatggatttcctgggcctaaggactcttaccgttatccaggatgcagtccatctgatcgagaaaagggaagggaagcccttcgacataaatcagatcgacacagaagatcccaaggtatatgaaatgatcagccaggggcggacggaaggcgtgttccagctggaaagcggcggaatgaaagcgtttatgaaggaactgaagccggaaagcctggaagagatcatcgccggaatttccctttaccgtccggggcctatggattttattccgagatatgtaaaagggaaggtggacaaagacagtatccgctatgactgcccgcagctggagaagatcctgaagcctacgtatggctgtattgtatatcaggaacaggtcatgcagatcgtaatggagctggccggctatactcttggccgcagtgatcttgtccgccgtgccatgtccaagaaaaagggcgatgtcatggttaaagagcggaaaaattttgtctacggaaatgaaaaagaggatatcccgggctgtataaaaaacggaatcgatgagaagacggcaaatcatatatgggatgagatgctggactttgctaaatatgctttcaacaagtcccatgcggcagcctatgcggtcgtcgcctaccagaccgcttttctgaggtgtcattatcagaaagaatttatggccgcattgctgacctctgttttgggaaatactaataaagtatctgaatatatctatgcatgcaggaaaatgggaattaagattcttccgccggatatcaataagggggaaggcgcattttctgtggatgacggatgtatccggtatggactgagtgccataaagagccttggaaagccggtcattgaagagattttacgggaaagatccgagggcggcagctacaagagcctgagggatctgatagaacggctttccagcaaagaaatgaacaaaaggaccgtggaaagcctgataaaatccggggcgctggacgaacttggatatacaaggaaacagcagatgttcgtatatgcaagtattttggaaagcatccagaaggagcggaagcatgagatatccgggcagatgagtattttggactttatgtcggaggaccagcagaagaactttgagatagaatatcctgacgttggggaattcgataaagagcagagactggccatggaaaaagaagtgcttgggatctatgtaagcggacatccgctggaagatgatgtggagattctggagcggctcacaacggccagcactgcagattttacagctgaggaggacacgggacagccggtgctgagggataaacagacttgtattatcggcggcatcatcagtgatatgaaggtgaaactcaccaggaccaatcagaatatggcatttctgacactggaggatctgatgggaacggttgaggtcattgttttccccagagaatttaataagtaccagcaccttttgaaggaggatgccaaaatctttgtaaaaggaaatacttcgatttcggaggaagagagcaagatggtcagcagccagattactgtgtttgatgatcttgcacaggaagtctgggtgcagtttgatgataaagaccgtttttttgcagaacaggaccgtttttatgacattctgaaatcacatcagggcagcaatcctgtcatcgtctactgtcggaaagagagagccgtgaacaggctggaccggatgtatgcggtaaacagtgaggatgaactcatttatgctcttggagaacagtatgggaagggaaacatcagagtcaagaagacagggttaaaataattatattgaaaacttttaacaaatgcattaaaatgagtctaacaaaatataattttatgctattatttggaggattataacatgggaacaccgaaagtaagaacaattggagtactgaccagcggaggagatgcaccggctatgaatgctgccaccagagcagtcgtaagggtcggcctggagcgcggtttaaatgtaaaaggtattagaaaaggttataatgggttattgaatgaagatatcatcgatctgacttcaagacatactgcagacagtatttcacggggaggcacaattttatttaccgcccgctgtgatgagtttaagacaccggaaggacagaagaggggcgcagaagtgtgccgggaacaggggatcgacggactggtagttatcggaggagacggttctttccagggagcccagaggcttgcggaacttggaatcaacaccattggaattccgggaaccatcgatctggacattgcatgtaccgagtatacaatcggttttgatacggcagtcaacacagccatggaagcgatcgataagatcagagatacatctacatcccacgagcgttgcagcattgtcgaggttatgggacggggtgccggatatatcgcactgtggtgcggaatggcaacaggagcagaggatatcctgattcctgaaagttttgacggcaatatgccgaagctggaacagcagatcattgaacacctgctcaggaacagagctttaggaaagacacatcacatgatcattaatgcagaaggtgtcggacactcctacggtatggccaagagaattgaggcggctacaggaatcgagacaagagctactattttaggacatatgcagcgaggcggaagcccgacagccaaagacagggtatatgcttctatgatgggagcttatgcggtggatctcttatgtgcaggaaagagcaaccgcatcgtcggataccagaacggcaagttcatggacatcgatatggacgagggactggcaatggaaaagcatgtggatgattatcaattacagattgcccatttacttggaaaataaaaagattttatggaaaaagcgatcttttaaagatggctttttctgtatgtaaggagaattgaaagggaatgaaaaagattaagccggtccatattattttgtttggattcttatttgtcatactgattgggtctgtgctgctgacattgccgatttcgtcaaaaagcggcgaagccacgccgtatattaacgcactttttacatcgacaacgtcagtctgtgtaaccggactggtggttgagacgacgatgacttactggagcaccttcggccagcttgtgatccttgtgctgatacagctgggcggactgggcgtgattacatttaccacaggaatgttcctgtttctgaaaaaaaagctgacaatgaaaaacaggatgctgattcaggagtccttcagcttgaatacaatgtccggccttattgagctggtgaggaagattttaaaaggtacttttattatagagggaatcggtgcggcgctgtttgcaacccagtttatccctgagttcggtgtgagatacggcatctgggcatctgtgtttaattctgtatccgcattctgcaatgcgggcatcgatattatacagaccgacagtctgagaagctatattacgaatccggctgtgaattttacggtcatgggactgatcgtgctgggcgggcttggttttattgtgtggagagacctgctcagggtcttccgcggattaattcacagggagtttccgttaaaaagagcttttgggaaattgaagctgcactctaaaatcgtgctgtctactacggtcatcttaatttttattggtacagtcttcatttttatctttgaatttgcaaatactaaaaccataggcaatctgtcacttggcaataaactgatggcatccatgttccagtctgtcacggtgaggaccgcaggatttgagacagtgcctcaggctgcactgacagaaggatcttcactgatctctatgatcctaatgtttatcggaggatcgccggtgggaacggccggaggagtaaagactgtgacgtttgttgtgttagtatactgtgtgcttgtgacagtgaagcaggagggtgcgattcatatatttaaaagaacgataccgatgacagtcataccgaaagcactgaccattatctgtgtcaatttgattgtactgctgtcttctattttggtcgtactggtatccgattcagcctcctttatggatacatgctatgagtgtgtctctgcgctgggcactgtgggtctgagcaaaggtctgaccccggacttgagtgtgatcgggaggctggcgatcatcatcaccatgtatcttggcagagtcgggccggtgtctctggcagtcggtttcgcagtccgcggaaaaaagaaagtattggcaacatatccggaagaagatataattttaggataaaggcattgttcacatgattttcgttcggctcttagaatgcctcactccaatcatgtgaacaatggagatagtttctacagtacaaattgtgttttgcaggaatatattttatacgatgatatataaaggagtaagaaagatgggaaaatcatatgcggtgctcggcctcggaaagtttggaaagagtgtggctctgaacctgatgaaagacggcgccgaagtgctggcagtggatcagaaggaagaattggtccgggatattgtggattatgtcacctgcgcagtctgtgcggatgttacggacatggaggtgatgaacagtatcggtctggaagaaatggatgggcttgtcattgctaccgcggagagtctggaggccagtgtgatggctttgatgattgctaaagagatcggagttccgtatattctcgccaaagccgatggcagactgaaaggagagatactcaaaaggatcggtgccgatgaggtggtatatccggaagaagagatgggagcaaggactgcctacaatctggtcagcgggaaagtgatggatctttttgacctttcctcaaagacgagtattgtagagattcacctgaaaaagggatgggtcggaaaaaatctgcgccagctggacatccgggggaaatacaacatcaatgtagtggcgattcacagcggcgaggactttaacggagcgccggatcccgatcagattctgaatgaacgtgacagcctgattgtcatcgggaataaagaggacttaatcaagctcagataaaggaataacttatgattacaacggtacagaataagcagatcagacaggtgataaagcttaaaaaaagttccagggagaggaaaagaaccggattatttgtggctgagggccttcgaatctttcgggagattccggaagagcagagggcaaaggtttttgtttccagtgactttttaaagctgcatggggaagaactgaaaggtattccgtttgaagaggtttcgcctaaagtgttccgtgagatttcggatacggagacgcctcaggggatcttgtcccttgtgaagatgaaacaatcgactctctctgagatactaaagcgcagcggaagcagtattcttcttctggagaatctgcaggacccgggaaacctggggacgctgattcggacgggagaaggagccggtgtgagcggcatcatcatgagcagggatactgtggatatctataatcctaaagtcataagatctacgatgggctctatattccgggttccattcacttatacagaggatcttgccgaaacggtggagtatttaaggcagcagtcggtacatgtgtatgcggcacacttgaacggcacagactatacagatgaatcatacgataagatcagcgcatttctcatcggcaatgaggggaatggactgacagacagaattgcggcgctggcagacaagaggatcagaattcccatggaaggccgggtcgaatcattaaatgcagctatggccggaggacttcttatgtatgaggccaggaggcagaaaaaaggaggtagctgattatgtatacggtatactggttgattgcggtagctgttttcctgttgcttgaaattctgacattgggacttacaagtatttggtttgcggtgggatctttagcagcagccatcggtgcggggctgggtctgccgtttttcgggcagctgatcctggctgtggcagtttcctgtgtggtttttgtatttgcaaggccatgggcccaaaaatatctgaacaacaagacggaaaagaccaacgcagaaagcctgatcgggaagacaggaatcgtaaagaaaagaatcgtcaatatcaaaggacagggaatggtctatatccagggaatggagtggacagcgcgttctgccgatgatgatgagatcccggaagagacagaggtaatcgtagaggaaattcaaggcgtgaaactaatcgtgagcaagaagtaggaggtgcagagtgtttattttattattgatcttattttttattatcatcatggcgatgctttccagcatccggatcgttccgcaggcaaatgcctatgtggtggaacgtctgggagcattcaaggaaacatggtctgtagggcttcacatcaaggtcccgttcattgaccgtgtggcaagaagagttaacttgaaggaacaggttgtggattttccgcctcagccggtcatcacgaaagataatgttaccatgcagatcgacaccgtagtttactttcagatcacagatccaaagctctattcctacggagtcgagaatccgatcatggcgatcgaaaacctgacggctacaacacttagaaacatcatcggtgatctggaactcgaccagacactgacatccagagaaacgatcaatacaaagatgcgtgctaccctggatgaggcgacagacccatggggaatcaaagtcaaccgtgtggaattgaaaaacattattcctccggcagcaattcaggatgccatggaaaaacagatgaaagcggaaagagagcggagggaggcaatccttcgtgcggaaggtgaaaagaaatcttctattcttcgtgcagaaggacataaggaatctgtgatcctggaagcagagggtgacaaagaatctgcaattctgcgcgcagaagcgaacaaagaagcgacgattagggaatcagaaggccaggcggaagcgatcaaacagatccagcaggcgaatgcagatggtattgaattcttaaagaaagcctctgcagacaacgcagttctgcagttaaagagcctggaggcattcgcaaaagcggctgacggaaaagcgacaaagatcattatcccatcagaaatccagggtatcgcaggactggtgaaatctatcacagaagtggctgaagatcaaaaaccgtcactaaaagaccaaattgaagagagtttgaccaattcttcaaaataagatataatatttattagtgtgtactttttcataacggaaagacacgaatattatcatttaggaggaaaaaggaatgagattgaaaaaagttttagcagtaggtctcgcagctgtcatgggaatcagcctggttgcatgcggcggcggaaataagaaagactccaaggaaaagacatataagattgcgtctgacaccacatttacaccattcgaatttgaagataaggatggaaaccgtgtaggaatcgaccttgatttattagaagcgattgcaaaagaagaaggattcaaatacaaagtgactgcagtaggatttgacgctgccatggcttctgtggagtccggacagagcgacggtatgatcgcgggtatgtctatcacgaaggaaagaaagcagaaatatgatttttctgaggcttactacgattctaaagtagctttcgctgtgaaaaagggcggaaaaacatttgataatataaaagacaagaaaaaagcagaaaaagaagcactttccagcctgaaaggaaagacagtagcagcaaaggtaggtacggtaggtgccacatatgccaacgaaaatgctgaaaaatatggatataaagtaagacagttcaaggattcaccgaccatgtaccaggcagtgctgacaggaaatgcagctgcatgttttgaagacttccctgtcatttcttatcagatcggtcagaagaatcttaaattacaggttgctttcacatccgagagcggaagccagtatggatttgctgtaaagaagggcaaaaactctgaacttgtagagaagtttaacagcggattaaagaagatcaaagacaacggaaaatatcaggaaattgtagataaatatacaaagactaagtaggcggacagattatgaactttatagaactatttcaacagtattttccgtcattctcgacggcgctgggactgacactgcagcttgccctggcttctctgatctgtgccagcatcatcggtattatttttggtatgttcagcgtatcaaaaaacaagatactgaatattatctgcaaaatttacgtagatattatccggggaactcctcttgtcgtacaggtatttattatgtactatggagtggcgggagcctttctgcagcctatggatttaaactgggatgatttcggaggtccttttgtggctgccgttgtagccctcagtttaaacgccggagcttatatggcagagattgtccggggtggaatcgaatctgtggacaagggtcagatggaggcagcaaggagtctgggactgccttacgggaaggctatgtcaaaagtaatccttcctcaggctatcaggaccatgcttccatccatcattaatcagttcatcatttccattaaggatacatcactggtttacgctatcggtatccgggagcttacgatgaacagccagatcattactgcaaacgagccgacctctgtcatgagcatttatgtgatggcagccatctattacctggtgatctgcaccatcctttctaaggtggcaaatattgtggaaaggaagttgtcttatggaaaataaagataataaaaaagtgaaggttcaagtaaaagggctggtcaagagttttggtgagctagaggtattaaaaggaatggatctggaagtcgcagacggagaggtcgtatgtctgatcggaccttccggttccggaaagagtacatttttaaggtgtcttaaccgacttgaaacgatcaccggaggagaagttgttgtcgacggattcgacatcacagacaagggtacagatattaataaagtgagagagaatatcggcatggtgtttcagcattttaatctgtttcctcacaagaccgtgctggaaaacattacaatggctccggtacagttaaagaaaatgacattggacgaggccaagacggtcggaagaaatttgctgaaagatgtgggactcgaagaaaaggctgatgtctatccggcacagctttccggaggacagaaacagcgtgtggcgattgcgagggcgcttgccatgcatcctgacatcatgctgtttgatgagccgaccagtgcactggacccggagatggtcggtgaagttttaaatgttatgaaacagctggccaagaatggaatgaccatggttgttgtgacacatgagatgggctttgcgagagaagttgcggaccgtatcattttcatggacggtggatatatcgtcgaacagggagaaccgcatgaactgctggccaatccaaaggaaccaagaaccatcaatttcttaaatcaggtattataataaacgatacagagcaaccgcttcttatgacgatgataagaagcggctgtttttattccataggaaaattcgtcctatggaataaaagccctgcgggcagaatgcacagcttcgcgcgctgaacaaaagctgtgtttagaaaaaattggtttgcgaggtgtgcgaagcacacttttgttcttctataaggaggtttcttatgaaaacaatactgtgttacggagattcaaatacatacggctataatccggaaaatggtttccggtatccatatgacttgagatggacgagtatattagagaaaaatatggagggacgggccagggtgattccggagggcctcaacggaaggaccacctgctttgaagacgagatccgtccgggcagaaatggttttgcctatctggaaccctgtctccattcgcacgggcctctggatctggttgtgctgatgctcggaacaaatgatctgaagatccgtttccagctgaccccggtggatattgggaaggccattgaacggctggtcaaaaagatacttgagatcactccgcagaagagagaggatggaaagccgtctgagatccttctggtgtcgccgatcctgatcgggcaaaatataagcgaagtggcagacggagagactatgggttttgagagggcttatgaatattccaagcgcctggcgcctgtttataaagaatgggcggacctttatggtattcattttatggatgccgcacagtttgcggaaccgtccgaaaaagatgcatgccatttgagcgcggaggggcacagaaagctgggagaagccatcagtaaggcttgtgaaaacatattgggtgctatataatgattgttatgcaaagtccataaaacggaggaagaaagatgaatttaaaaggaagaaattttttaacactgaaggattttaccccggaagagatcagttacctgctggatcttgcggcacagttaaaagaagataagaaaaaagggatcacaggagatagtttgaagggtaaaaatatcgcccttatttttgaaaaaccgagcactaggacgaggtgcgcattcaccatcggatgtatcgatgaaggcggacatcctgaatatttaggaaaggacgacatccagcttgggtataaagaaagtgtagaggatacggccagagtcctcggaagaatgttcgacggaattgaattccggggatttttacatgaaaatgtggaaaagctggcgaaatacagcggtgttccggtatggaacggacttactgatgattatcatccgacacagattttggcagactttctgactctgagagaacagttcggagaattaaagggattaaacttcgttttcgcaggggacggacgcaataacatgggcaattcgttaatgatcggatgtgcaaagatggggattaacttcacctgtctggcgcctaagagcctgtggccgaaagaagaattaatcgagcagtgcagaacgtatgccaaggaatccggagccaaacttacctttaccgaagacaccgatgccgtgaagggagccgactgtatttataccgacgtttggtgctctatgggggaagaagacaaagccgcagagagggtggctcttctgaagcccttccaggtcaacgatgaactgatgaagaaaacagagaaggatacaaccgttgtcatgcactgtctgccggcggtaaaaggaaatgaagtcacggaagatgtatttgaaaaacatgcagaagtgatttttgatgaggcggagaaccgcatgcatacgattaaggcggttatggttgcaacactcggggaaaaataaacaatgaaagaaaagatactcatacgattaaaacaatgcggcggctatgtatccgggcaggaattgtgcgaaacattcggggtgtcgagaaccgcagtctggaaacatataaaggcattaaaagaagaaggctacgtcattgactctgtgagtaataagggatataaactggtgaaaagcccggatattcttctggcagaagatataaagagcagtctgtcaacttcctggcttggtaaaacggttaaggtgatgaagacagtggattccaccaatctggaggcgaggagactcgcggaggcgggagcttctcatgggacacttgtgacggcggaagagcagacttcagggaagggcagaagaggccgttcctgggtttcagtgccgggacagggtgtctggatgagttttgtgctgagaccggatgtggaactggaaaacagctccatgctgacccttgtggcggctctggctgtagaaaaaggaatcaaagatgcagcaggcattgacggaaagatcaaatggcccaatgatgtcctgatcaacggaaaaaaagtatgcggaatcctcacggaactgagtgctcagatggatgaactgaattatattgttgtagggatcgggatcaatgccaatattgaacaatttccggaagaagtcagggacaaagctacgtctctgtttttagagacgggaaaacctgctgaccggatcgcacttctctgcagagttttggaacattttgagcatgattatgagatctttaaaaaaactcaggatttttccatgctgatggaagaatacaacagttttcttgcgcatcgcggacaggaaatcaaagttatgaggggaaatgatgaatatatgtgtaagtccggggggatcaaccggcgcggagaattgatcgtggaagattctcttggacggaccagagagattttttctggagaagtatcgatacggggaatccacggttacagtgtataaacaggaggaagtatgtatcaggagaccataactctatgcggttccaatggatatgaaaagaaatattatttaaatgaagattttgaatcccttccccagcagatcaaggatgaattaaagattgcctgtgtgctgtacacagaagagatcgggggcatcttaacgcttgagtttgatgaggacgggaagctgtcatttaaaacgacagcagcggaaaatgattatttttatgatgaaatcggaagtgcactgaagataaaagaaatgcagcgggacagagcggatctctgggaatcgctggaactgttttttcgggtgttctttctgggagaagaggtataagcaatgttattgactatggacgtgggaaataccaatattacagctggtatctttgtggagaaggatctggtggaactgtttcgtatcacaacgaaacttccgagaacttcagatgagttcggaatcctgatccgggatatgatcgccgccaaggggctggatacaaaacagatcagcgctgcgatcatcggatcggttgtgccgaatatcatgtattctctcaccaacggaatcatcaaatattttgatgtgactccggtgatcgtcggacccggcatcaagacaggaatcaacttgggaagactgaatcccagggaggtaggagcagaccgtatcgtggaccttgtagctgcctatgaaatttacggggggcctactctggtaatcgattacgggacggccactacctatgacgtggttacggaagacggagtatttctggccggagtcaccgcaccgggcatccgaacctctgccaatgcattatggaagggagcggcaagacttccggagatcgagatcaagacgccggagagtatccttgccacaaatacgatcacaagcatgcaggcgggacttatgtacggagtgatcggggagaccaaatatatcattgagcagatgaagaaggaaacgggatttaaagacatgaaagtcgtggcgaccgggggacttggaaagatgatttccagggaagtgccggagatcaactgttttgacgatacactgacattgaagggattgcggattatttatgaaaagcagcagtagactaaacccgctgatcattggagatattgaaatagaacatccttttttgctggccccgatggcaggagtcacggaccttccttaccggctgctgtgcaaagaaatgggtgcgggacttctctatacagaaatggtcagcgcaaaaggtatgtattacaatagtcccaatacaggacctttgcttgcaaaagaagaatgggaaaggcccattgcggcgcagatttttggctcagaaccggaactgatggcggatatggctgtccgggtccaggaaatgggttttgaccttattgacattaacatgggatgtccggtgccgaagattgtaaataacggagacggatcggctctgatgaaagatcctgtccttgcaggaaagatcattaaagccatggcagacaggttaagtgtaccggtaacggtgaagatcagaaaaggttttgatgatgaacatgtaaacgcagtggagatggcaaagatcgcagaacagagcggagcggcagcagtcgctgtccatggaagaacaagagaacagtattattccgggaaagcggactgggatatcataagacaggtcaaagaagccgtttccattccggtgataggaaacggtgatatcaattcacctctggatgcggaagcgatgcttcgggagaccggctgtgacggctttatgattgccagaggagccaaaggaaatccgtggatcttcaaagaactatgtcattattttgacacaggggaactgatgccgcggccggagattgaagagattatccagatgattctgagacatgcgagaatgatgatcgagtacaaaggcgaatacatcggcatccgggagatgagaaagcatgtctcatggtatacccatgggctcgccggtgcggcaaagctgagagatcaggtaaaccatgcagagagtataggggaactggaggcgatcatcagaaataacggggcgtcctctgttgacaaataaaacagtactgagatataatttacggatgagcgtgtacgaaccagacggacagaaggattgatatagaaggaaaggaagcgaaaatatggcagaagcaaaaaagaatattctgactcaggagggtttaaaaactttagaggatgaattacaggatttaaaggttgtcaaaagaaaagaagtagcccagaagatcaaagaagcgagagagcagggagacttatcagagaatgctgagtacgatgctgcgaaagatgagcagagggacattgaggcaaggatcgaagaattagaacagatcctgaaaaatgcagaggtgatcgatgaggaattccagcatggtgtcatcagccttggctgccttgtaaagttagaggaccttacatttaaggaagaagttacttatcatatcgtcggttccacagaggccgatatcctgaataataagatttccaatgaagcaccgatcggcaaggcactgctcggggcgaagatcggagatgtggtagaagtggaaggcgtaggccaggtgaatcaatataaagttttagacgttaagagaaagtaagagggttggaaagtggcagaacagaacaaagatgcgggcgaacttgtcagggtacgcagaaataaactggaagaattacagagtgcagggaaaaatccgtttgagatcatgaagtatgatacaacgcaccactctatggagatcaaagatcattttgaagaactggaaggaaaagaagtgtctgttgcaggccggatgatgttcaagagggtcatgggaaaggcttctttctgtaatattcaggatcttgagggacgtattcaggcatatgtggccagagacgaaatcggtgtagaggaatacaaggattttaaaaagatggatatcggagatatcattggaatcaaaggaactgtatttgtgaccaaaaccggggaaaagtccatccacgcaaaagaggttgtactcttatcaaaaagtctgaagccccttccggagaagttccatggcttaaaggataccgatgccagataccgccagaggtatgtggatctgatcatgaatgaggaatctaaaggcacgtttattaaacgttctaagatcatcagcaagatccgttctttcttagacggacagggatttatggaagtagaaacaccgatgctggtgccgaatgccgggggagcagcggccagaccgtttgagacccactataatgcattggatgaagacgtaaaactccgtatttctctggaactttatttaaagcgactgattgtcggcggtctggaaaaagtgtatgagatcggccgggtattccgaaatgagggtgtggacaccagacataatccggaatttacgctgatggaattataccaggcgtatacagattataatggaatgatggagctgacagaaaacctgtaccgctacctggcacaggaagtcgtgggaagcaccacgattacctacaatggcattgagatggatttgggcaaaccgtttgaaaagattacgatggttgatgctgtaaagaaatatgcaggtgttgactttgacgagatccatacggttgaagacgcaaggaaagccgcggatgaacaccatgtggaatatgaagagcgccataaaaaaggagatatcctcaatctgttctttgaggagtttgtggaagataaacttgttcagcctacctttgttttggatcatccggtggagatctctcctcttacaaaaaagaagccggaaaatccggactatgtggaacggtttgagtttttcatgaacggatgggaaatggcaaatgcctactctgagcttaatgatcccatcgatcagagagaacggtttaaggcacaggaagaactgcttgcccagggtgacgaagaagcaaattccacagacgaagattttctgaatgcgttagagatcggtatgccgccgacaggaggcattggctttggaatcgatcgaatggtcatgctgctgacagactcatcagcgatcagggatgtgctgttattcccgacgatgaagtcactggatgccaagaagggcggggcaaaggcggaaaaagctgcagcagcagagaaaaaaacggctgagaaagttgatttttccaatgtaaaaatcgagccgctttttgaacaaatgattgactttgacacgttcagcaagtccgatttccgtgccgtgaagatcgaggcatgtgaggaagttccgaagagcaagaagcttctgaagtttactctgaatgacggaacagaccggaaacgcacgattttaagcggtattcacgagtattatgaaccggaagaactgattggaaagactgcagtcgcaatcgtaaatctgcccccgagaaagatgatgggcattgattctgagggtatgctgatttcagcagtacacgaggaaggcggaagagagggattaaatctgctgatggtggatgaccggattccggcgggagcaaagctgtattaaatcttaaagctttttaaaataaacccgatcttagtacagataaatatatagtactacaaggacacttttctaaaaaatatgttagagaggtgtccttttctgttatggtcaagaaatagaaattgaaagaatttttagtcaaagtcaaaaagtaacgaaaaaaggagatgtggaataaaatgtattacgaagataaataaaggaagaaatattgtgttagcaacatctattatcattatcctggctgttgtagcagcggctgtgctgattgccctgatcatatggcgtatcagaagccgccgtttccgtccgactgcggatatacagcgccagcaaatggaattaaatgccgacctgaaagatgccgggtttgcatatgaaataaacggtgactacttttattcactgatggactgctggcagcgtgaggtcggatactgccggctttatgatgaagcagcgccgatgtttaatatgatcatggactgtgagcctgttgaattctcctatggaggaaagagatggctgatcgaactgtggaagggacagtatggaataacaacaggaggagagatcggtatctacaacacaaaacgggaggatatcgatcacgaaaaattcaaaggaactttctatgaaaatatacgggatgatgagagacttccgttatcttatgtattgaggaaaaacggaaaagttcttctgcgccgcagggcggtccactggtggctgaccggctttaaactcggtgagttttcagagacggatactcttactatggacgcatccatcacgtttccaaaccgtgaaatgagggattcttttatagatagtttgaagaaacttggttatagaagaagagaattttcggtgcgcaggaatactgtgaatatccattatacggaacctcattcagtgcagccggaagccagagacggcattcaggaagctgttgtacagaaaaccaataaaaataactgcaggctgtatgaatttaccacagaaaaatatccaaatacacttgataagattgaatatataaaggctgtcatgccggagctctatacaatctttgtggattctctttacgcaaaaggaatttatgaagcatttggatggatcaaagactggctgacgggaaagcggcccgagccaagaccgccgcatccgccaaagccgccgtgtccaccgaaaccgccgtgtccgccagagccgccgtgtccgccagagccgccgtgtccaccgaaaccgccgtgtccgccagagccgccgtgtccaccgaaaccgccgtgtccaccgcatccgccatgtccatcggaacccccatgccatccgtgccgatcctgtccgccgagacggcagtgtgattccaatgactgctgctgccggccgtcagattcctgtcatcattgcggaaagcacagagaagaatgaactgccgggcagtagagcggaaattggatcaggtatataaacatgttccagttataccatttgattccggcacaaaactggtagttatgagtgactgccacagaggacagggaaatgcaggagataattttctggctaaccaggcagtgtgttttggcgcactggagtattattttcagaaaggttttacctatgttgagcttggagacggtgacgagctgtgggaaaacagaaaattaaagacaatcgtagaggttcatgatgacattttctggatgatgtcgagattctacgaagagaaacggctttatatggtatatggaaaccatgacatcgtgaaacggaataaaagctatatgcaaaggcactgcggatgttattactgcgatgctgcccatcaggtgcagtctctctttccggatatctctgtccgggaggggctgattttccgaaacagaaaagatggaaaagaaatttttatggtacacggacatcagggagattttctgaacgataccctttggccggtttccaggtttttagtgagatatgtatggagatatatggaattgatcgggtttttagatcccaccggagccggacgtccgagaaaggctaaagagcggatcgaaaaaagactggccgattacggcagcagcagaaaaaagattttgatcgccgggcatacgcaccggccggcgttttcaaaaccgggagaaggaacctattttaattccggaagctgtgtgcatcccaggtgtattacatgtattgaaattgaagacaatcggatttctctcgtaaaatggtctgtccggtccggagaggacagaatactcagagttgagagagaggtactggaggacccggtatccctgacagagtatgccgcagcagagaagtaaataaaagagtaaattatgaggtacagactccttggtctgtaccttgttttgtgatataatgtcaccatgcccagatatgcagctaagaaggaggggtacatcctgtgatttcagaagaaaaagtaaagattatgacgtccctggcccaatatgaaaaaaaagagggaaccggagatttacgcataaaccggtacagctgcggtgattatgtaagaatggagacgatgaaagtaggcgtggccttagtggttgcactgcttcttttaacagggattatcgttattttccgcatggaggatgtgatttccatgatgagaaagggaacgattgctgttccggcaatactaatactgatttgtttcgggattctttttttctgctatgtaaagtctaccagaagaagggcagagaagcgctataatgaggccatggtacgaatcaaagcttatgaaagacagcttgaaaagcttcttgaagtttacgaagaggaagaaaaagaggacaacagtcctaagatagatatggatgcagaggagttggcagatggaaaaattattgatttatagagaaaaaattttgaatttcctgtcttcccactggcaggtttgcggcccggtgggaaaatttatcggaggagtgtttatcttttatgtgataaactccctgtttgggtattccaaagtgttgaatcagccgttcagtatcctgattctggcaggaatctgtgtgtttcttccattttcaatgacatttttactttgcaatctgatcatcatcattcatttatccatggtatctgttgagattggaatcttatatttcataatacttggtatttactatctgttatatcagagaatgtttccggggatgagataccttttgtttatgacaccggtatttttcttttttcatctgcctgctgtggtgccgctttatgtaggttcttttatcggcattacagggattccggccatcgtcatgggcacattcttatatatttttgctatgacggtccaaagcggtgttgtacaggtaaacaacggctccttcggaagtcagctgtataattttgtgcttcagggaactatagaaaataaggaattgattgtatatatcctctgttttatatttgtagcggcactggtcgtgggcattcgaaaaatgcaggtggattatggatggtacttttcgatttttatcggagggattgcctatgtaatcgttgtcctcgtaggagggttttttacgggcaaccgtgtagatatcgcaggggaactggctgtcgcggcattaagcatcctggcggtcatgatcatgcagtttttcaaagttgtcattgactattccagacaggagacgatggagttcgaggacgaggattattactattacgtcaaagcgattccgaagagcagggtcaacgaagaggaaatcaatattacaaagatcaatccttcaggcaagaaatttggatttaaaaaacataagggagagtagatttggagcagtttttatcagtcatcgaaaagtatttatattggttgtccattccgcagatgtcaattacagatattctggatatcctgattgtcagcgtgctgatctatgaaattgcccgctggatcaaaaatacaagggcatggacgctgttaaaagggatcatgctgcttgttttcgtggcaatggctgcttatgtttttcagctgcacacgatctcctggctcatcaataatacaatgggagtgggagtgactgcggcgatcatcgtttttcagccggaactcaggaatgccctggaacagctcggtaggaaaaatcctatcgtaaatcttttttcttcagatgagagccgggatgagaaaataggatatacagaccggacgatacaggagatcgttcgcgctaccatcgagatgtcaaaggttaagaccggagcactgatcgtattggagagagaggttccgctgggagagtacgagaggacagggattcctgtggatgcgaagatgagcagccagcttctgatcaatatttttgagcataataccccgcttcatgacggggcagtgatcgtgagaagcaaccggatcgtatcggcaacctgctaccttccgctgagtgacagtcttgagataggaaaagaactggggaccaggcacagggcagcggtgggaatcagcgaagtttccgacagtgtgacgatcgtagtctcagaggagacgggaggtgtctccattgcccagggaggaaggatttacaggggactgaccccgcagcagctgagagaccgactggctgtggtaaagagtgattacagcgacggaagaaaattcagactctggaaaggattgaaccgcaatgaaagaaaaattaggaaatgatctcatattaaaagtattctctcttgttcttgcaatccttctctggctgtttgtcattaatacagaggacccggtgatcacaaaatctttttctaatattcctgtggatatgctcaatgaacaggtgctggatgaactgaacaggacttataagatcacggagggttcaaccgtcagttttacggtcaaaggcaaaaaaacagtcctcgataagctcaagaaaagtgacttccgggctaccgcagatgtatcttccatgtcaaaagtgaattcaattcctattaagattgtaccgctgaaatttgcagatcagctggagattgtatcaggcaacaaccaaagcgttaaagtgaaactggaagacctgaggagagtccaggtaccggtaacggtagagacaacgggtagaccggcatcgggctatgcagttggaagcaaaacggccgcgccgaacctgatatccatttcagggccaaaaagtgtggttaagcaggtaaaatccatcaaggtcatcgtggacgttaccggcctgaaaaaggacatctcgatcactcataaagttgtctgctatgacagtgaaggagaacaggtagatcagtcccggctgaagctggacaatgatgaagtaaaagtgaaaataaaattcagcaggactaaaaccgtgccgattgtagtcaagacaaagggaactccggctaagggctatgcccttggaagtatcgactattcacctgaggagattgagattaccggtgagcaggacgcactggatcaggtcgatgagatcgcgctttctacgatcgacataagcaacagtacaaaaagtatagaaaagaccatcaaagcagcggacatcaaactgccggaagggatcacatttgtaaaagacacaagcaagatcgaagatatcgtcgtaaaagcaaacattgagaagtataaaaaacggacgatcactctctccacggatcagatccagctgatcaataatgaaaataattataagattgaattcgaccagtctgaagtaccgatcaaagtgacggggctgaaatccgttgtagacgatttgacggctaaggatttaaatccgaagattgacgtctctgtctatgaaaccggcacgcatacggtccaggtccagctgaaagaagtaaaaaatatggacatcataggaaacgtacaggtaaaaatcacagtatcagaataggagcctaattatgaagacaatgtcaatcgtccttccggcttataatgaagaacagatgatagaaaaaacggccgggacaatcgcccggctgatggagaatgaagacataagctatgagctggtttttgtcaacgacggatccaaagatcagacatgggaacggattaaggaagcttcaaagaagaattcaaatattaagggaatctgtttttccagaaattttgggaaagaaggagccgtgtttgcgggactcgccaatgcctccggagactgtgtggcagtcatggactgcgatctccagcatcctccggagactcttatcacaatgtaccggctttgggaacagggttatcaggtgatcgaaggcgttaaggcctcgagaggcagggagggatttcttcacaaattttttgccaaaacattttataagatcataagcaatgccacaggggtcgatatgtccagggcatctgattttaagcttcttgaccgggccgctgtggatgaatttctgaaacttccggagcggaatgtgtttttccgggcactgtcttcctgggttgggtttaagactacttatgtggaatttcatgtccaggagcgcgaggctggagaatcaaagtggtccatgaagtcactgttcaaatatgccattaacaatattacttcgttcagtgctgtgccaatgcaggtggttacattctgcggtgtgatctttttcctgtttgcaatcgtactggcagtacagtcactgtatctgtatttcagcggaagggctgtggccggttttacgacagttatactgcttctgctgatcattggaagcattctgatgttcagtctgggagtgatcggatattatctgtcgaaaatctacgaagaagtgaaaatgcggccgagatatattatatcagaaataacagagacaaagaacgtaaactaaaaacagcggagggatctgaatccttccgctgttttgctatgaatcccagtcagtcgctttgacccaattttcatagtagtgcatctgccggtgttttcgtatcgttctgcgttctctgtaatagtagggaaacatcctttttttgacccgcatgtattttggatcctgaggcggaccgatgggccggtcaggagggagctgcctgtaatatctgccgaaataatagagccggtcaaaatcatgttctttttttgcggcagaagttacgatgttagatgttccgatatggtgagggtgcccatattccccttcagggttatgggtagcgatcactttccatttcttataccgaagtaaagtcaggatatcttgttcaatgcggcccttgtatggtttccatgagacgcgtcttctgttgacatagtccgggtagttcagcataatactgggggaaccggccacgttcatggcatatttgaattctttatatctagtgagatggtatgtacttgcattggtaaggcacacaaccagataccggtcttttgccagatgggcgccgccccacagagattcatcgtcgggatgtgccacgatcataaggcggtcaacaccttttaaatccaaggtgtccaaatatttatttgtagcatcttctttcaccggcagagaagtactgtgtactgccaggacaaaggcaaaaattagagtgaagcatatgattatcttttgtgaacggtcaagtttcatgacggcctccgttttgagggtttctaatttgaatgtaaaatcgaatataacggatgagttatataagctacattattatagaatcaaaggcagaggttttcaagagagttcgatgttttgtaagattatttaactttataaaaatatctgttatattgtcactcaaaatgtaacaaaatgataatataatgaaatgatgccatggtcaaaaaatttttagcgcaagatcataaagttgtttcatcctttgcagttgtttctttaaatacaaggaatttactgataaaatagtttacgattgtaacgataatttgagtttccagctttgcaagccattttgcctggctgatatactggacgagaacaaaaacaccgccgacttcgatgatcattgtagaaagacgccccagaacaaaacggcagaattcaatccatacttctttccaggaagaacttttggatacaaatacaaaaatcttattcacaacaaaagcaaatacgatagcggaagctactgaaataatgttactgattgtatagtttacttggcaggcatacaccaaaacattaaaaattaaaaggttgacaagtgttgtgcatcctccgaaaaaaacataacggagcccttgattgttccataatttttttattatatttatcatattgatttcctctttcggtttctatagattttaacttattacattataagattacatacaatattttgcaacaatatgaagaatttcttacattaacaaagatctgaacagcaatatggaaatatatagtcgtctatgatataataaatcatattttaatttatgatatcatatcttgacagctttgttctggaaaaagaagatcagatttaaaggagagacattcatgacgccacaaaagaatacaagaaaatattatttactatatctcgtgttatttgttttcatgtgctttacagcattttatccatttattgcggagggcaaatcttttgtctgggccgcaggggtagaggacgggctgtcacagcattttgaatcactggcctattggggacattacctgcgggaactgtttaataatattgcatcaggccatctgtctcttcctatgtggaatatgagtctcggttacgggggagatattttatcgactctaaattattatgcgatcggagatcccctgaatcttctgtatatctttgtgcctgtgaaacataccgaggctatgtataacttcatgattctgctgcgcatgttcctttctggtgccgcatttatggcatatggaagaaagatgaacaaaaataattttgcagttgttttaggggcgcttgtctatgtattctgcggatttacgtttcggtcagggctgaggcatccgttttttatcaatccgatgatttattttccgcttttatgccttggtgttgaaaagatttttaaaaaggaacggccgtttttatttattattgtcacggctgtggcctctatgagcaatttttatttcttatatatgctgactatttttacggtaatttatgcgctgattcgcttttaccaatactatacaaaggaacggctgaagaatttttttgttctgctcagaaactttgcaggatattatatactgggagttgccctgtcggcagtgatccttctgcccgcagtctatggatttttaggaaatggacggggaggcggacaggtccacaatctgatcgcatatcccttcaaatattacgttttgtttttggaaaattttgtggggtacggaaacagcggacagtctaccaacgtaggtttcattccgattgccggcatcgttgtattatttttgatgtattcaagaagaatgaaacacaaaaagtataagatggcatttgtcggatgcatgatattcctggcactcccggtgttcggatatatcttcaatggtttttcttatgtgaccaaccgctggagttttgcgtttacatttattatagcactgcttgtggcagagatgtatccgaggctctttcacatgtcaaaacgccagattatcggtattctggtgggcatttcaatctataatctgatcatcaaagtggcagagctgagcaagccggaagtatttaaaaatgatggggcttacatcgcaggcatctttttgttcttgttttatttggtcttcctcttctttcagtggaaaggaatggatgataaacatatggtgactcggattgccgttgctgtcctggttgtggccagtataggagtccatgggttttaccgctttggtgacgggggaaggtactatgccggtgaatttttagattcaggagaggcattgaaagcgattcagacagaggaaaataaacggttgagaaaacaggcgggcggacagctggtcagggtgcacgatgagggccagagatttcacaattatggactgttggatgggctgaatacagtcagtgcctattacagcattattccaaaggagataatggaagctgtaaaaagttatgagactttgggaatgcagtacgcagataaataccatggactggacctcaggcagggacttttaagtcttgcctctgtaaaatacattacggtgccgggaagccagaagctggagggataccgtctcctggatgaaacagaagaatcgagggtgtatgaaaatccatatgcacttccgtttggttatacctatgattcatggatcagccaaaaaaaatatgatacaatgaatggagcagagcgggagcaggccatgctgaaatgtgcggttctggaagatgaggtaaaaggcctgaaaaagcagagcggcctggcagcgcagacagaagacaaaattctttccgggaaacacagtacgtctgtaaataaggccggtaaaagtaaagaataccgtttaaaactcgatccggagaaagatcactatatttatataaaaaatcttcattacagtccgttgacaaagaataagtctaatattggcgagattgctttgaaagggaaaaagggaaaccgtggaattgatgtgacagacggttcggaggaacaccatatttatattcaggataagatgagctcctactattttggaaggcatgattatctgatgaagatatcggacagcggaaaacttaaattccagtttccgagtaccggaacgtataaggtggatgaggtttcgctaatttctgtgaagccgcaggatatgaaaaaggagatgaagaacagaaaacgtaattcattaaaaaatatttcctataagaataatgtttttaacggagagatcacgacgaagaaaacaaaattattatgcattccgattccgtattccaagggctggtcagccgaagttgatggagagaagcagcaaatcataaaaacaaatggaatgtatatggggctggtgctgaagccgggagaacacaagatcactttaagataccggacgccatggctggttccgggggctgccgtcagcagtatggccggatgtatatttattatttatatagtaataatgagaaagaaaagaggagttatatgagaaaaataatcggaggattggcagcagtctgccttgtaggcaatctctcgctttttcagccggagataaaggaagtaaaggcggacacagcagaaaatacatcggtttctgtcacagatacagatgaatataaaacaaaggaagtcattgtaaagtttaaagacggcctgtccgagaatgagaaggaaaacatcatgaatgagtccccgggagatgcacagcaggtgaccgactccatggctgtcgtaaagacagatacgaagaaagagacggcagcagcagttaaaaaactggatcaaaacagcgacgtagaatatgttcagccaaactatgtctatcggcttgtagacggaaacggcaggacatcagggaaagagactgcgatgaagacagcaggagtcaatgatccattcttttatgtacagtgggggctattgaactatggatcgaatctcgcagattatgtctatgatcaagaagggagacaggacgagactatttcacagaaaaaaggattggatattaatataaagaatctctggaaacagatgaacaaaaataatacccaaaaagtaatcgttgcaaatattgacacgggagtggattattccagccctgatctgaaatctgtcatgtggaaaaatccgaaagaaaagaagaacggaaaagacagcgataaaaacggttataaagacgatatttacgggtggaatttctataataataacaataaggtattttcaaataagtattatcgagtctccaaggagtatgtctcttatgaagacgaccatggtacccatggtgccggtacgattgctgctgtccgcaataacggatacggcatcgcaggcattgcgtccggtacaaatgtaaagctgatgtccataaaagttttgggcggaaaaaagggagaagggacaacactcagcgtcattaaaggaattaaatatgcaaaaaagatgggggcgaaaatctgcaatttcagctttgggtcctatcaaaatgacaggatgcttcgggatgtcataaaagaaaataaagatatgctgtttatctgtgccgccggaaatgagagaaataataatgaccggtatcctgtttatcctgccagctataattacagcaacgtaatatctgttgcgaatctggattacaacggatatttagacgggtattcaaactacgggaaaaagagtgtgcttttggctgctcccggaactgatatctttgggctgggtgtcagagaaagaggaatcattgaaagcggaacgtccatggcagctccaatggtgacgggtacggcggcgctgatctatgcaaaatatccgggagtaacaccggccatggtgaaatctgcgctgaaacgcggagcaaccagactcagcagcttgaatggaaagacagcttccggcgggtatttaaatgctgagaagaccgtcaattccaattattatcctccatatattacggtaaagacatcaaagaaaaagaattattctctggtaaaggtaagtgcgaagaaaagaggcagtacgcaaattacaaaagtaaaatacataaagggcaagaagactgcttcatactttgcaaacgggaaaaggggttattctgtaaaaaacagttccattaaagttaaaaagacagactattatacgatatatgccagagacaatgcgggaaatcagacagtaaagacagtaaaaataactgcggggaaagcgccgaagcttaaagtgaaaaaatatagaaagagccgaaaaagtacgaaggttaaaataacagcttcagatgagagcaagaagacattgaaattcagatatgcaaaagggaaaaaatcagtttcctattttaaaaaagggaaaaaaggaacgaaattaaaaaataaaaaagggaaagcagaatttcaaggaaaaaaaggccgttattataccgtatatgtcatagacaaaagtgggaatgagatcatcaagaaaataaaattatagtgaaaaaactttcattagcagttgagaaatgtctgaatttgttaaaagaattaggcaaatatgttgtagatatgttacttttgtgataaaatagggaatcacagagatagggttaggatggggactgatatttactgatcagcatgagagagaaagtatgaggtgtagtatgaaaaagctaaaatttttactgcgaacggcatcattatgtatggcgtttattttgatgggcacaaatagtgtatcagccaaaactcctaaggtgaaaaaaatcaaattctctaatgtttcttctaaaaagaccatgtacagaggaacaacgaaaaagtttacagtaaaaattacgccgtctaaggcgaagaaaaggaaaatacagtggtattccagcaataaaaaagttgcaacagtcaactctaaaggagttgttactgccaagaagaatggaaaggcttacataacagctagaataaaatcacaaaaatctaagaaagtaagatgcagagtcactgtaaaaacgaaaaaggtatccaaggtttcttttaatacaagtaaggctgtacttcaacagggaaagtattatacaagaaagccttcagtgtcgccgtcttacgcttataataaaaaggttacatataagtcatcaaacactaaggtggcaacagtaaattcttccggaaagatttatgcaaagggacaggggacagcgacgataacagcaaccgcagcggatggaagcaaaaagaaggcaagttatccggtgagggtgattggcaaaataaaaagcagtgatgcaaactttgttgcacaccgcggattaagttctgaggcgccggagagtacggtaaaagcatttgagctagcaggagatgcaggcttttggggcgcagagacagatatacgaatgacgaaagatggtaagtttgttgccgtgcatgatactaccttaaaaagaacatgtggtgttgacaagaggccggaagatatgaccgaggcggagatccgtaaattaaagattatcagcggcaacgggtattctaaatataaaaatgatccgaaagcaaataaagtagcatttttagacgaatatcttgatgtgtgtaaagaaaaaggaatggtcccggtcattgaaattaagatggaatatacaaccaatggaagagttgcggacagcaggatgcagggagttaaggaaggtgatttacagaaattaagtgaaactgtggagaaaaaaatggacggcgaacaatatatgttcattgcctatgattttgataccatggttgagatgaggaaaattgttaaagatatgccaaatgttaagcttcagcatgtgaccaataatgcagacgcagggatgattaactattattataaaagaggaattgcgctagactgtaattatgagacgatttctgatgcgacgttgaagaagtttcttgattctaaagtactggtaaatttgtggactgtggataatgaagaaaaagtttgggattttattggtaaaaaagtagattatattacgacgaataggaagttttggtagttatatgactctgaatctaaagaaacaaaataaatagctggtaggaaaggaagcggttatgaacgaaaatgacgagattgaaattgacttgattgatatgtgtaaatactttttgtcgaaatggattattattatagtagctgtgttcatatgtgcaggcgcggtatttgggtttagtaagattaaaaacaagaagttatatacggctacaactcaattatatgtaacagttccaaggacctctgataaagtgttgatcagagataatgcgaatgaattgatgcaggattatatggcattaataaaaactgatttgatcagtgataaagctgctaaaaaagcaaatatatcaccggataaagtaaagagtgctatagcagtggaacaggtagaaggtgcaaggataatcaaacttatagttacggagcgagactcaaaacgtactatgaaaatatcaaaatcagttttggacactacaattgagacgattaccaagacattgaaaaaaaataaacctgtaattttggaacagtctaagaagccagaaataaaggattcgataaatattaaaaagaacactgttatcggtgcggcagcaggatttattttgtcattaggaagtttatttataatatatcttgtaagatattcaaagagaaattaaagaaatgaactgagtcatacaaggggtaggatgataaagtatgaatgttaaaaattctcagatacagaatttgattatatttacaattgatattgtgggaatatcaattgggtattttctaatgacttttttaaggtttagaggaacgttcccggtagatcctgaaaaaatggttttctatcgtttatttattgcggtttttgttttgactttattgtatttagtatttaatccaaaccatgatttttttaaaagaagtttttggcaggagttaatctgtaacattaaaacaaatgttatggcagctgcatttatggcaacagcagcatatttgattgatgatgccagggattattcaagatttatatatattatgaccatggcattcagtttagtgtggatgcagattatgcatagaatttatcgattatacatgttacactatagaaagcatagttccatgagccggaaaatgctgattgtaactactagcgacagggctaaagaaataattgaaaatattattagagaaaaaacgtggaatttatggattacaggagtagttattattgacaaaaatatggtgggaaaagaaattttatctattcctatagttgcagattatgatacaatgatacagtacgctattcgttctgtagtggatgaagtttttattcatgtaccggataatcagcttattcctatcaaagaaatgatttgtgcatttgaagatatgggcataactgtagatttaaatattcacttatttgaaatggagattgatacagaaaagtatttacaaaaaataggtaaatataatgcggtttcatttgttcagaaaaatactcctttacatatgattgtaataaaacgagtggtggatattattggtgcatttgtgggattagggattaccggagttgttacacttctaattggaccattaatcaaattggaatcaccagggcctttatttttttctcagcttcgagtgggaagaaatggaagaatatttaaaatatataagtttcgatctatgtatgcagatgcggaggagcgaaaaaaggaattactggatcaaaacgaaatggaaggctttatgtttaagatggaacatgatcctagaattacgaaaataggtaatttcattcgtaggacaagcattgatgagttacctcaattttggaatgtgctgaaaggtgatatgagtttagtagggacaagaccgccaacagtagatgagtttgaacaatatgaaggatatcataaacgcaggcttagcatgactccaggattaaccggtgtgtggcaggttagcggtagaagtgatattaaagattttgaagaaattgttgcgatggatgtggattacataagcaactggtcactgaagagagattttgagattattttgcgaacagttcaggtagttctcaggagcagtggggcaaaataataactattatttgagggtagtaaagcatgaaatctgttaaaaaaaagcatatcttcatcattggatcaaagggaatccctgcaaaatatggaggatttgaaacatttgttgaaaagttaacggaatatcaaaaagatgcgtcaattcaatattacgtagcgtgtatgaatgcagataaaacgacatttaaatataatggggctaattgttttaatgtacatgttccaaacattggagcggcaaaagctgtttattatgaccttgccgcattgaaatggtgtattagttatattaagcaacataagataacagacgctgttgtttacatcctagcatgcaggatcggacctttcatcggtcattataaacgacagatgaataaattgggagtccaattatatatcaatccggatggccatgaatggatgcgtgataaatggaactggattattaaaaaatattggaagtcctctgaaaaacgtatggtaaaacacgcggatttattaatatgcgattcaaaaaatattgaaagatatattcggtcagaatatggcatgtatcatcctaatacgacgtttattgcttacggtgctgatattgagaaatcttctttaaaagataatgatccaatattgacaaactggtacaaacaatttcatatccggccgaaggaatattatctggttgttggccggtttgtcccggaaaacaattatgagactatgatccgggaatttatgagatgtaaaacaaagaaggattttgttttgatcaccaatgtagaaaaaaataagttctatgaaagattaaaaaaggagacaatatttgaaagtgataggaggatcaagtttgttggaacggtatatgaccaggaattgttaaaaaagattcgtgaggatgcctatggatatcttcatggtcatgaagtgggcggaaccaatccttctctgcttgaggcactgggaagcacaaaattgaacttgttgttggatgtagggtttaatcgggaggttgctgaagatggagcaatctattggaataaagaagaacaaaatcttgcaaaaataatcgtagaatcagaaaaattattttttgatcagatccgatgttatgaagaaaaagcaaaacaaaggataagagaaatctacaattgggaaattattgtagacatgtatgaggcaacatttttagatgttgaaaaggtaggaacatgaaaatattaatggttaacaagtttttttatataaagggaggtagtgaaacttactatttttctttgaaaaaacttttagaacaacacggacatgaagtgattgatttttctatgaaggataaaaggaattttccgtctgattattctgaatattttgtcaataatgttgattataatgataaaaatactatattaaaaaaaattcaattagcgaaaaatattatatattcaaccgaagcaaaaacaaaattcgagaatttggttaaagctacacggcccgatataatccatttaaatatatttcaacatcaaatttctccttctattttagatgtgataaagaaatatcgtatcccaacggtctatacagcacacgatttgaaaatggtttgtttaaactataaaatgatgagtcatgggaaaatatgcgaaaaatgcatgcatgggcattattttcaatgtctaaagaatcgctgtgttaaagattcttttgtaaaaagtagtataaatgtaattgaaggatatgtacataagtttagaaaaagctatgattccatttcaacaataattacaccgagtctattttataaaaaaaaattagagcagtttgggattgaaaaagaaagaattgtgcatattccaaattttttagaatctgatactgagtgtatacagattccagaaaatctcaaaaaatattatttatattttgggcgattatctgaagaaaaaggagtattaacccttatcaaagcagcagttaaaagtaaaatagaaatgtacattgtgggcacaggccctttaaaagaacgtttagaaaaatatatagataagaataaaataaaaaatgtaaaaatgcttggtttcaaaagtggaatagaattaaaaactcttgttggaaattcaaaggctgtaattttaccgtcagagtggtatgaaaatggaccgtattccgctattgaggctctacagcttggtaggcctttaataggatcggatttaggtggaatcccagagctgatttttgagaataaaaatggatatatatttaaaaacaaagatatttctgatttaaaaaaatgttttgataaaatggaaaacttaaatgcttctgaatatcagaaaatggaacggtattcaaaagatatttttgataaatattatacgtcaaaagtctattataaaaaaatttttaaagtttattctgatttattaatttagaggagaaatttataatgagagctagagtaattgcttactatttgccgcagtatcatcctgttccggaaaacgataaattttggggtccggggtttacagaatggacaaatgtagcgaaagcaaaacctttgtttaaaggacattatcagccacagattcctgcggatttagggttttatgatttacggttatcagaagtaagagaagcacaggcaaaattagcagcagattgtggaatagaaggcttttgctactggcattattggtttggaaatgggaaaaaggtacttgatatgccgtttaacgaagtattaaaatcaggttcaccggattttcctttttgtctaggttgggcaaatcatagctggaccacaagaagctgggaaaaaggaaaaagcttctcttctgattctatgatttttgaacaattatatcctggcgatcaagattatatagatcattttttcgacgtattgccagcatttaaagataaaagatacattacagtggacgggaaaccgctttttgtgatttttcagccggatgatatacctgattctaaacattttattgatttatggacaaacttagctattcaaaataatttaaaaggaatttattttgtatgtaagtatgacgcattacctgttatgaatactaaaaatttgaagaaaattgatactttaacaaaaccaagatacgaaagaatattatcacaaggatacgatggcattaattctgtgacattaaagtatgcagaatttaaggctacaggagtactgcataaagcagtacattcttttttgagaaaatattttgggggtattgtattagatagatataagtatgatactataatgaatcattttattatgccggaagattttgaagaatctatttatccgcagttaattccaaaacgagatcggtcacccagatcaggaagaaaggcgatgatttattatggcagtactcctgagaaatttaaatctgctgctgaaaatgcaattaaatgtgtagaaggaagagataaagaacataggctcatatttttaaatgcctggaatgaatggggagaaggagcatatatggaacctgatctcaaattcggtcacggctacttagaagcactgaaagaaatcttaaaaaagaaaaagaaatagatttctatcctttatctggagaaatataatgaaagtttcatcgacattaaatttaagaaaatttaatacagcaattttgtttgtcttattattgtttattacttgtttagactcgatttcagataacattcttctaaacctcttttttaaacatgtagatgaacttattactattatcctattatgttatattatttgtaattataggatagtattcaaaaaaaagagttttgtattatgcatcgcctttggtttcttactgattgggtttatatccagttgcatataccactatcaaccagtaattcctatgcttatcgacgcatttcttttgacatctaggtttttaattggatatttagcagtaataatttatgcgtcaaaaaagaataaaaacatttctggagggctgacaagaattgttaaattcataaccctgatattgtttttgcttacattgcatgatcttgtattgtctcccttcttccctaaaagtgattatcgttactttatgtacggcctgcagttaatgtttcctcatgcaacctatttagcttcaagtgctgctgttttattgatatatttgggctataataacagaaatggacagaatttgaaatatatgcttatggctacgttttttggggttgcaacgctgagaggaaaagcgctgggattctttgcagtttattggtttgtctatattattataaaatatgttaaaagtaaaaattattactttacatattttttaggtataataggaacggcgttcattgccagggatcaattgacagcttattttggttctatagatttatattcccccagacttatattatttaaagatggcctaaaattaatgttaagccattttccatttggtactggatatgctacttttggatcttctattgcagttaattattattcaccattgtatgttgcattgaagtatccgtataattgggggatgagcccttcctacagcgcatttttatcagatttattttggccaacaattttttctcaatttgggattctgggcttaattttatttttattcatcatcatatattttttaaaattatcaatgagaaaaatgagattaaacaaaaatgcaggatttgctatgttaatgactatcgtttacttgttaattacgtctattgccgaatccagtttttttaatccaacagcattattattttttatgttgtttgcagtctatgagaaagagatgtaatccagagacttttataatatatcaaggagagaaacagtgtttgttagcatattaaatagactaaaattgatccagtttaggaagacatggagaaaatataattcacataatacaacaattgcggccaatcagtttgacgttggagccgtttgtgtcggaaaaaatacttatggagcaatccgtgtattaaactggggaaaagatgaacatttaaagattggaaattattgttcgatagctcaagaggtaatgtttattttaaacgcagatcattttacacagaatatatcgactttcccgtttaaagttaaatgtttaggacagcagcgtgaaggtatatcaaaaggtgatattattatcgatgatgatgtatggataggttatcgggtgattataatgtctggtgttcacgtcggacagggggcaattattgcagcaggggctgttgtgactaaagatatacctccttatgcaattgtaggaggggttcctgcaaaaattattaaatttcgtttctctaagaatataattgaaaaactcttggagattgattacaaaaaaatcaatgatgggtttattaatagaaatataagacatttttatgaaactattgaaaatgtagaacaactgagttggctagataccgaagaaattttaaaaaattaaaattattgcagtttgatagaggatcggtcaagggatttgagagaaaggattataaaattgatggaaataatgcctaatcgtatggacagaggattttttaaatatcaaaacgaatttgaagctaaggctctagaggtattgcggtctggctggtatgtgttaggaaaggaagtcaaatcttttgaggaagagtttgcagcatttactggagcaaaatattgtgtaagccttgctagtggtttggatgcgctatggattgcttttagaattcttggtattggcgctggagatgaggtgatcgttcaaggtaatacctatattgccagtataatggggattaccatcaatggtgcaacgcctgtttttgtagagccagatgaaagttttggaatagatacagaaaaaatagaagaaaaaattacttcaaggacaaaagcagttttagtggtgcatctgtatgggatggcctccagaatggataaaatagtacaaatatgccaaaagcataatttaagactagttgaagattgtgcacaagcacatggagcatgttttgaaggaaaaatgacaggaacctttggtgatgtcggatgtttttctttttatccatctaaaaatcttggtgcttttggagatgccggagctgttgtggtaaacgatgaacaacttgcaaaagattttaggatttttagaaattatggaagtgaaaaacgttattataacaagactgttggcgcaaactcaaggttagatgaaatacaagcaggattattaagagttcgattatctcatatccaggaattaacagaagaaaaaaatatgatagcagcaagatatagtacagaaattcaaaattcaaaattcagtctgcctttactcgtaaaaggagcaacctgtgtatggcatcaatatgtaattcgatgtcataaacgagatgatttgatgaattacctgaatgaaaagggtataggaacaattattcattatccaattcctccgcatttatcagaggcatatcagtatcttggatacaaacatggttcattgccgataactgaaaactttgctgatacagtactttcaatgccaatgtataatgggatgaaaaccgaagaacaatcctatgtaattgatgctctcaattcgttttgagcagatggaaatcagtgcggacttggcgtaagaatgttgatatcagtaatactaatacaagcataaatccaggctttgaggatggaaagatcacagcaggttttacgaaggacttttaaatatagatagattcttctgtgaagattgcagaaactggccatccggcgaaatcgagttgatttgggataagataagtttacgagctacggtaatatgtcatttattggtgccttgacggataccctataaaaatatacggggttgtaatacgcagcccttccacttcacctcctcagattctatagcatatagcaatctataaaaggggggataatataaaggtacgaaaggaagatgaagtttgaaatgtttcataaccctatcagtgcctttcgaagaaaggcggtttataaaatatgtctataaaagaaaaatgtccaataatacattttgatgatttaggtgacgaaagaggaaagttagttgttatagaaggtggaaaagggataccttttgatatacaaagagtattttatatttacgaatccgactcaatggttgttagaggacaacatgcaaataaagagtcagaatttgttctaattaatgtatctggaaaaagcaaggtcagaattacagatggaaaagaagagtttgtcgttgaattaaataaaccaatgatgggggtatatattccaacaatgatttggaaagatatgtatgatttctcgtctgattcagtactactggtgcttgcaagtactcactacaatagtaaagaatatatacgtgattatgatgactatttaaaaatcatgggggaagaggaaaacaatgagtaaaccgctattatctttgtgtatgccgacaaatggggttgtcgaatgggtttttccagttttagaaagtatatataaacaaggttgtgataattcgttatttgaagttgtaattactgataatgggaacaatattgaatttaaaagattaattaaaaaatatgcctctgagcatgacaatatcctttatgcggaaacaaaggtgcttccatttcataatgaaattgaatcttataaaagagcttccggtgaattaattaaatttgtcaatcaccgcacacttttgattgatgggacattacaaatactaatagactttatcgacagacacaaagaaaaaaaacctattatttattattctaatggggtattgatgcttgagcgaaaagaaaatatgtttaaaacatttgatgaatttgtatgtaatttatcatattggtcttcttggtccacaggcatgacaatatggaaaagtgattttgaaaaactgcccgttgatatatctaattttaatgagttatttcctcatatggatgttcttttcgcagagaaagaaagagaaaattatattattgataatagaaagatctttaatgaattgccggtgaatggaatatctaaggcaaagtatgatttattttatgctttttgcgtagaatatttggcaattattttgaaattattgataaatggagatattaaaacttctacatttttaactattaaaaatgataatcttatatttattagtaggttatatttaaattttgtaataaggaaaaacccctgttcctatgatctttcaagtttaaaaaattcaataaaagtattttatagcagaaaagaactattttttgcagttttcaaattatctttaaataaaataaaaaggaaggggtagaatatggctattttcgttttttcacaaaatgttaaacttgatagtttaaaaaaatatgctgatttaaaagaagataagaatgttattattactactcattttttgtttgagaatgaaagaaaattcctggaatcgttgttcgtaaatattgatttttatacttttgcagattttttgtctgatacagaaatggagaaaatagatttagaatcttattcttctagtagtataccatatgaagagtatctaaaaaatataaaaaagaagaaaaatattttggttatttcaaaagttgtttctcaatttcagaaagggaaaaaatatatattttctgatgacttaggaatagagttaaaagcatgggaaagaatggggtttaagtttctggaatgcgattattattatcactccgaagcattaacatttaaacaaaagattaagctgagattaaaaaaaatacgtttattgagaaaattaaaatcattagtaataaaaagaacttttatacatcaacctaatgaagtgagtgtagcgtattataaaggtcacaaatatgtttttttaggaaaaatgaatagaatagactatagattgagcataccatttaaaccttctgaagaagaatgtcatagattaaacaaaggagaatttgaaacgaagcagttttgtacttacatgacaacttggcatgaacatgggaagtgtaatgtaccagatgaagataaatatgaagttcgatgggctcaagatggctatcttcccccaaattattctcataaagattatttttttaaacctaataatgtcaagtacttttgttgggatatattagggactcaattgttcaaaaatcaggggttaccatatgagatgataccttttagaaataaactatatttaccagagcccaaatttccaatgaatgtaaaaaatgtgttaatagttgcatcgggttccggtgattggacagcgttaaaaaatagatctgatgatgacattatggttgatgcttttgttcaaatggctagaagatttcctaatatccattttatatacagatgccatcctacttggattcatccacaaaatgtgggtgtaaatgcgataaatagagtacataattattttgaatggttaggattagaaaatttaacattatcaagcaatatgcctattccagatgatggaaaggaatttcggttctccttttcgagaagtactcttgatgaagacctgacaactgctgactttgtatttggtgaacattctatatcaatgattgatgctgcttttaaagggataccttttagttcagtcaatcttacaaagagaagaaatttttttgttggaataaataatttaggatttccttcatgcagtacaattgatgacatagcaagtatgatcgatcttgcgaatactgttgaattcaaaaatacttatttaaaagcagtaatgaactataataatatgacaaagacagataaatagatcgaggttctttcatgaatatattgctgaggaaatataataatctttcaaaaccaattaaagcggcattatggtttactatttcaaatgtattactgaaggggatttcttttataacgttacctttattcactaggatgatgtctacagaggagtatggaattttatctttgtatcaatcttgggttcttctcgtcactattactattacaatgaatgtatggacaggcagttttaatgtcggtctatcaaaaaatatcgaaaaaaaagatgagtatgccgctgccgcacagggattgggtattacaatttctgtaatctttttggttctgtcgttagtgaatattaaaaagatatcgggtttttttggattaactcagataattactttggcagtgtttctgcaagttctctttgaaataccaattaatgtatggtctcaaaaaatgagatttgattattcgtataaaaaagtagttttagtatctgtgcttacggctattattaatcccattattggttattttttagtgctatattctacgaataaagctgatgctagaattcttagtttattaggagtacaaatcttttttggtttagtgttaggcattagcaatttggcaaagggtaagaaattctatgacaagtcaatttggagatatatatttacatttaatatggttttgattccacattatttatcttaccagattttaaatcagtcagatagggtcatgatatcgaaaatgtgcagcaattcggatgctgcaatgtatagcgttgcctataatttctcaatgttaattactcttgttacaagtggaattgaagctgttattactccgtttacttttaaaaggatgagagatggtaaaactgataaattaaaaaaagttgttaatatagcagttgttattgttgctttaggttgtatattacttatgtgctttataccagatgtatttagattaatgatgaccgaggcttattatccatctctttctattatacctatagtctcatctgcggcattttttcagtttttatatcctatttttagtaatgtcgaattattttatgaacaaaaaaaatatattacatttgcgtcatgttttggtgctgcaataaatgtaattcttaattatattttcatacaattgtttgggtatattgcagctgcttatacgactctagtatgttttattttattctgcataatgcattttatttttatgaataaagtgctcagagagaataagagtaaaccagtttatgatattaaatttattttactgatatctatatttttgctgataagttcatttataattctaatattatattcaaattcaatagcaagatatattgtgataagtgtcattttaatgctgttagtttttaatagaaagaaattaatggatctttatgaaaagaacttaaaaagttaaaaaggagatttttatgtattcaaacgaaaaaagtgttcaaatacttttaaagcttctcaaagagtataaaattaaagatgttgtattatccccaggtggttcaaatgcacctattgtaaaatcatttgaatacgataaagagttcaattgttattcagtggttgatgaaagaaatgctgcatatgttgctttaggaatggcacagcagttgaggaggccagtggcttgcgtatgtactgctgggactgcagtaagtaattatttgcctggaataacagaagctttttatcaaaatgtaccggttgttgcgattacatcggatggattgtcatctctgcttgatcaactagaacttcaaaaaattgatcaagtagggattttcaaaggttgtattaaaaaagaggttgcacttccggctgttaaaacagaaatggatgagtggtattgtaatcgtttagtaaatgaagctttattagaattaaatcatcatggtacaggtccagtacatatcaacattcctattacattatctttggaatgcagtgagaaggtacttccaaaacaaagaataattgaacgacatactatttcaaacacagacttttctacattttcaagttatttaaggaataagaaaattatgatagttgttggagaaaacttaaatataaaagaaacacagataaaattatttaattctttttttgaaaagtatgattgcttttactcagtagaagctgtttctaatttgaactgtaacggatgcgtaattacttatccgataacagagacagaatatgcgtttaagagacctgaattaatacctgatatagtgatatccctaggaaattttgttgcaacttacaaactcaaagagatattgagaatgtataataagaaaattgaaaattggcttgtttcagattctggatgtgtaagagatccttatttttctttaacaaatatctttgaaggaaattttgttgagttttttcaaaaattaacgtgtgttgattttagtgaagcaaatcatgaatattataagaaatggaataatgcggccagttctataaatttgggtgatttaaaattttcaagcttaagtattgcaagagaactctcaaagagcattcctgattattcaattcttcatacagctattttaaacagtacgaggatcactcaattttttgattttaataagactgttaagtactacagcaatctaggtgctttaggaattgatggatgtctcgctacattcatcggtcattcattagtgacagaaaacttgtctttccttttaataggagatttgagtttcttttatggaatgaatggaataagcattcgaggtataaaaaataatgtaagaataattttattaaataatggcggtggagaagagtttaaaattaagttgccatatactggtatggataaatttgtatgtgcgcaaaataaaagaactgctaaaggatgggtagaatcacttggatttgaatacttttcagctgccagcaatgatgaggttagagatgctctttcaatttttgcgcaagaatcagaaacaccgttatttctagagatatttatagatattgatgaagattctgaattaatacgtgatatttatgcttcgaatacaaataatcattctacagcatctgtatctctgaaaaaaggtatcactaaactattaccaagtgatgttaaagataaaattaaaaatatattaaacccgtgaaataaaatgatgggagagttacagtgaatttaattcgtagattatttagaaagattaaaaatatgttttcccaaaaggagataatacctatttatcaacctgtagatacaaataaaattcttcagaataaagtgattttgataactggtgggactggtggcattgggtttgcaattgcaaagcaggcagttgccagcggggcaaaagttatattatgtgggaccaatgtagctaaattaaataagctatctttggagttgggagaaaatgcaaaaagttataattttgatctaagtagcttagatgatgttgaaaatatattgagagagattacttcgatttttcctgaaaatcgcattgatattcttgttaattcagctggtattcatggagaattaaacttccttaatgaaagtgtcgaggaattcgataaagtaatgaatattaatgtaaaagcaacttattttatcagtcaagcagtagcaaagcaaatgattgaaaaagggattaaagggcatatattaaacgtctcttcgtcatctgctttaagacctgcttcaactccatatcaaatatctaaatgggcagttaatggaattacgaaaggattggctgatgtcctcttaccatatggtattattgttaatgccattgctccaggtccaacggctacttcaatggttaaggatgttaataataaaaatctttattttgaacaccagccatctcacagatatgcgactcctgaagaaattgcaaatttggccatttttatgttaagcgatatgggaaatatgattgttggtgacacttactacataagtggcggtagtggtacaatatcctatcaccgttagatagacctgtttttaaaatttaattcttataatgctttttatattaaattacataagtgtaatttgggcttaaattttgaaaacttctataaatagtatttaataggcttggaatcttttcatagacatggattaaaaggaagaaataccatttcacagtatctccaaaattatggtatcagtccctggagagggcttataaacactacaacttattacgaggaagagaaaatgaaaaattataaaataggatatacaacaggagtatatgacatgtttcacattggacatcttaatattcttaaaagagctaaagaacaatgtgattatttaattgttggtgtgagtactgatgaagttgttaaaagctacaagaataaaacgccaattattccatttgaagaaagaattgctatagtacaagagctaaaatgtgttgacgaagcagttccacaaaaaaatatgaataaaatggaggcatggaaaaatcttcattttgatgctctgtttcatggatcagattggaagggtagcgatatgtacaataaaatgatcgatgaatttgctcaagtaggtgttgatgttgtgtttttaccacatacagaaggagtatcatcgacattactatcagaagtattgcataaaataaattgtgacatataacttaatataataatataaaaaattgagaagaaatgaaatcttttgatgaaagatagaaagaatcaaaaaataagaaaagagggtggagaaataaagaggtagacaaggttttcagagtgaataaaaaaatgttcatcttgtaaaaacgttgtggctgatgttcaaaggggtaacaggtataagatgtttgtgaatttaggtgaggtaattcaatgatttcataaacgccgctggcaagctatttaacagaaaacttataaggggtggaatttaaatattctatgtaatctggttatttaagaaataaataactgatttaccacaggtagtagaattaaaaaatatatgttattatagaacaaaaagaaaatattgttattaaatgtattcttttgatgaatatcatgataatagtagaatatttatataaaatagggaaatttagagacttagtggaaactggtatcttagcagaggattattataaactaattcaaacgaatcattattgggatgaatatgaaaattaataggttaaataggggtgactaatgaagcataaaaatgtactagataagatcattattttaatattaaaagtttttgtaatttcggcgttaattttaccggtcttaacaactaaagcaaaaaaccccgaattagacggctattattccagatttatattaactaatttttttgccctgctgggtataataataattttattgacagctttaccatataaacggtttatgtctcgatttttatttggaggatttttgttatttgctatttgtctgtgttataatattttatatttaaataatttggaagttattcaattttcttgggcttgttggaacacaacaattagcttcgcattattaataacacttttgttagtgaaaactaaagaaatatttgaacaaggaaatataattcgatatacaatttgggcaataattgtaactaatgttataggtgtttctttttatttaaaaggttatttgtccttacatatatataattttaaacttgttttaacgaaaatcgatcctaattactatgaaaaacgttttaactggatttatttctataaatgccagtattcctgtatgctgctgttatttataggattatttgtagtccataaaaagaagtttcgtaataagcttacctatctgctgagtcttgtaacgttgttctgctgtttgctcattgctcatacaaacacttctacagtttgcgctgtatttattttagcagctgattttgttgactatctgtttgctaataaaagatatctatttactaaaattacattattggtgatgtcttctctaggagcagcaaaattgatcttgagttggatagctcaagaaagagatctgagtaatttaggttccagaattccaatctggaaaatggcaatagaaaaaattaaagaaaatccacgaggattagggaatcgttttgctttaaatcctaaggattggttacaaattgcacctacatggaaaacaaataattgtcataatatttttttaaatgagatgcttagattttcgataccggttgggttctgttatttaggcttttttttggcaagctgtgtctattcgttgatgaaaaaattttcttttttaagactaagtatctggatatctttttttattgcagtttctatggattactcagttcagactccggaattatccatggttatgtttatgatttattgtatttttttctttcctttagaagaagtggaggaataagaaagataaagtattttagagaaaagaacattgggctttttagaagttacaagatttcattgaggttatcaaacgataaaatagaatattatctgatataaaatatctcaataaatataactactttgtttttacttaaggaggatgtaaaagtgaaactatatattgtagtaccctgttataatgaagaggaagtacttccggagacatcatcaagactgcaagaaaaaatgcagtttctaatgcagaatcagcagatttctgagaatagtcacgtcatctttgtagacgatggatccaaagataagacatgggctatgattgaagaattgcatcataggaattcattattttccggcattaagctgtctaaaaatagaggacaccaaaatgctcttctagcaggattaaatttcgcggcagagcatgctgatgcagctgtctctatggatgctgacctgcaggatgatattaacgctgttgatgagatgatcaaaaaatacaatgaaggttgtgatattgtatatggagtgcgtagtacgagagataaagatacattcttcaaaaagtttacggccgaaactttttataaggtattaaggcgtttaggaggcgagatcatctacaatcatgcggactatcgattgatgagtaaacgtgcattaaaaggacttgctgaatttaaagaagtaaatttatttctgcgcggaattgtacctatgatcggatataaatcggacactgttgcctatgagagaggggagcgatttgccggagaaagtaagtacccgctgaaaaaaatgttatcctttgcttttgagggaatcacctctttgagcataaagccggttcgtttaatatttgattttggagttgctatatctggaatcagtgtcattgtattgctatattttttagcacaatattttatgggaaatacagttagcgggtggactagcctgattatgtctatatggcttctgggaggatttcagttaatggccatagggattattggggaatatatcggaaaagtttatctggaaacaaaggcgaggccacggtttattaatgaagttatattaaataacgatggagagagtaaatgaagctgaaaaagttagtatattctgctcccttaatttggttatctattttcttggtttacctgcttttaagttttccatttatagttttaaataaagaaattggaagtatttctattgctatgcgtgtagcagccttatttttaagcttttctttgcttatttttgtttggattggttttactaaatctaaactaattgaaaaaaactattttgtgttgatattcctggggatagcagttatcttacagctcataattgtattttatttaaaaatacagccgaccaacgatttattatatctgcacgatgaagcgatttccatagttaaacataagcatgaaatttctttgaccaattttagaaattattttgcacaatatccaaataattatggttatctagctgttatctatacatggtataaaatagtaactttcttgggaataggtactaaatacttggttgcagccggcaacgttttaaacatcctaatgattaatggtggaattttattggggtattatgtaatcagggttttaaagacttgtagactggcaaatttatttctattcttttttctgttaaatccatggacttacttatctgtaccatattattatacacatacagcatcgttttttatcttaatgttagtaatagcctgtatgcttataattaaaaaggcaaatagtggttggaagaaaattatcttttgtatattggaaggatttatattatactggggaatcaaagttcgtataacaaacatctttccgattattgctttgatttttgttttttttgtattcggagacaaaagtaatataaatttacgaaaaataattttttcaggtgctctgatgttatgtgggatcctggctggaggctgcttctttcagggtgcctttggagacataatgcctaaaaataataaaaactcttttccaattacccattggctaatgatggcctctcatggtgatgggcgatttaacagggaggatgtttggtttacatctagttttaagacaaagaaagaaaaacaagatgcaaatattaagaggattataaaaaactatcaaaaggcaggaattaggggtaccgcaaaattagtgggaatcaagctgcggtcagtatggctgattggagatgatgacgcaagtaaaatgttagtcagtgcacctgattatactcggctgcatgactttatctctggtccggacaatggagggcttctgatgtattgctatctgtttaggagccttactttgttatttatgctgcttaatgttctatatttgttgaaaaagcctgattcgtggaactacctaattgcactgattttattaggagctatggtatttcattgtgtatgggaggctaatcctaaatatagtatttgttttatgggattgatggcttactcagcgattatgggatatgacggctggaaaaataagaaggataataaattgtcgttttctaaaaaatcattaataatttatcttgtttgcgcagtatgtgtggcagttatgctaaatattcgttatgacatttttagtatccggtctcataaaaataataaatattatgcagctgcccagatgaaaggatctcatactagggaaatcactgcgcagagaggggatattttaagccaaacattccaaacgtcaagagattttaataccatagacctgaatattttattttctaaaggaaaattccagattaggttactggatgaaagaggacagatccttcaaaaaaaggaaatttatccaaacacagatgaaagtcattttacctggaagttacttaaaggtgttatgccaaaaggacaaaaaggatactgcatatctgtgatttgtttatccaatggttcacagctgagagtacctgtttatcaaacaggaaattatgatgcgtatccaaaaggaaatatgatttggagaggaagggaatttaaaaatactgatattatctttggcgtatatcaaagaaataggaaataggtgcagaaaattcatataataataaaatagaaaaggttaaaccctgctgcaaagaaaattttgttagcagggtttgattttttaaagaaataattttgagatttcttttgtaatgacttcagacaatgctgataagtctttcatgggttgtttttttaattgaaatttatcatcttctacaattattgtatcaattctaaaaaattgtgataataaaacattatagtcgagtgggtcctgaggatgtaaactaacaataccatcaaactgggaagcataggatttatttaaaaatatatttttaagtattacaattttttcagataaggaatgttttgcaataaaagttaaaatgctatcatctaaataattgtaattatctactaaaaacatttggcaatcgttctgattacacccattcaaaaatgtttctaaaaagtataatatctctctgttttcatcattatttattacataaaggtaagagagtttagacttgtctacctttggcaacaatagaacctctttcgtcttaaatggtttattaccacaaggaatcataaaatattcccgattatcgtacacagctgtacgtatattatcggttgtatcttccagctgtttcttagaaggaaggattgggacagcggaacaatctgaagccaaatcggtatattcttctgtatttgacctgtgcagaccaacactaaaatagagtcgttcgtcaaatgaggaatatattcggattttgttggtgaatgtaaaagcagtggttttgttctgcacccatattgccttttctttggctagattctgataacccaaatacaatcttttctttgaagaaaatccttcaaagagcaaataatccttttgagtaaaatatccaaataatattgttgtatcaaaagaaatattattacaaatacgctgactgtttctcctgtatagctcaaagatatcctgatttacaatatctgttgagttatccatgttgtagagatattttgaaagatatctgtgcgctgcatatgcctctttatcataaggaagccggcctgaacagtctaaatatctgacatttttatttatttcagagattacttctttatcatttttcttgaaagatgatgcgattaaagttacatcaatctggttataatcgatccaatctaaagtatgaagtaagtgtaaataagcatgctgatccaggttttgcaggaaatcgatgaaaaatgctattcttttttttgtgctgtgaaaagatgttacgaatggggaagaagcattttcttttacagtactccagatggagttatccaaagtgtgaatgtatggaaaacttacttcgctattctgtaccatttctttaatcttttttgggctttgtggatttagattacaataagtcaataaatcggtatataattgttcatttaacaacctgttttttaagatataaaccggggttttcatctgaacaaaatcttcatataaaacatttccatctgtaattacacatctatattttagatcccggcagtcaatgtgaggaggtagaaggtactgactaatcacatcatttaattgaaatatgtcatatgccgcaagtggtacggaaatgtaaatgtcttcgaaatctaattgctcaataatatcagcataaaatgatgcagaagctgacatttcttccgctgttttgcactgcagtgctggaagaagtaaaacagtactttttgagtttgtactgtacctggacgcagaaggcaatgaatgagaagggtgaaagggcagtactccttggataattttaccgtcatacatatgttttaatttataggcactctccagcacagtcttctgatattgttcatttgaagagagaatataatctgcctgcaggtaatggcgttccacaaattgttctgtatcaacatttctaatacctttgtcatatcctgaaaatgtaaaggcagagtcatttcccgtgcagattagagtctgttcctcacgctttacgaatgttgaagtaaaataaccgtcagtaactaaatactgtgagacagcaagagattcgtaatattcagaagagtacctttctacaaaacgtatattacaggtttgttcataataggttaagtcttcctccaatagatcaggagattcaatgctccatatatgagtaagactggaatcagaaactgcatttaaaaacatagatttaggtttaccttttaaaccgcttccactgtccgcttcatagaagacagtatttttgataataggtttctttaaacattcgcaataaaaaattgtgttttttaaaccagcagcagaactctgcagctgttgatcaataccttttttgtattgttcataagataatttacgtttcttaattgtatccatatatctctccattaattctaatcaaataattgttcaaattctttataaacagataaattatattcatgggggtcaaagctgtattgtggaactctattttccatataggctttgaaaccactataaatgctctcggaatccttcttgatgaccagctgtccattctcaatataagtatcttttcctgttgaaaaatcagaaagtataatggggatttccaaaacccgggcttcttgtattaccattggctgtccctcataattcgacggcagtataaaacaattacattgttttacaaaagaaaaggggttatttaagttaccggtaagaacaacagaatccgtcaggccaagcgatacaatctgatttgtcaaatcatccatcagagggcctgcacccaagatatataattttgtattttggtattcctgatgaaactttttgaaagctgtaataaggttagcatggtttttttcaggggaaaggcggcccatagtcacaaaaacagtacagtcggagtcaggcatttccattatatccatgttgattttttgattatccaaattctcgtttatacattttatataataatcctttccttgaacctttaagaaagagggctgcatcagtgcttcctgaatgcgttcgtagtgaaccgtatttcttgcaaatgtaaatttatcttttattttagacgtagataaagactttctgtttacgtccatgactgatttactgcaggaaactagtttgtcatagtaagggtaagttgaaaatacaactttaagtcctttatttaaaggcatttgaccatttactttacggaatctgtcctttatcaggtcattgtgctgccagatatacttttttggaatatcagaaaatgcaaataaagtggcatggtgagcgctgtagccagtaaaatcaattgcatagtcaaatctggaattaccaaaaattcttttaaattcacgacgaaaatacgatttaggagcaattttatcccacagactgttttctattcctttctccataatcaatttatagcggatatcatcattcagactgctgtttgctccggcaactttagtgatgactcttacttgcttattcacagaattaataattggagtattatttatacttttgtttaaaagagttaataatgtaatgtcaaatttatcatggtcaatgatatttaataaacttaataaagactgagtaatgccattaggttttaaatcactgccaaatatgactacttttttcttttctgtcaccatatcagatataatgtgatacggtgatttgttgttctcaagcagaatatctaataggcggccgcagacattgccgtcatcatattgacagcatgatgttttttgttcgtgatatatgcttttgtatgtttcaataacagactcaagattattgatccatttcggaatatctgccatgatttttgtctttgggccaggcagagtgtctatagaatgataaagacctctgtatttttgatattcttcaagatccggtatataaaacaaaatagggcgcccagttgccagaaagtcaaaatagatactggagtaatcagaaactaaaatatcaactaccgataagatttcatttgtatcaatgatcgcaggtataaactgtgaagtaatgttcttattatttttaatatgcttgtatacaatttgatgcggtttaactaagacttgatattcatcagtatttatattagattccagagtatctatgaaattaaaatactcctctaaccctatatcaggatttccgtaatccccgcctttccatgtcggagcatacatgataatctttttgttcggatcaacatttactccataggaaatcagtttatttataatgtcatttctgtttgtattaaatagattatcatttcgaggttgtccttcctggatgatatttccttgatagataccatccagcttaaacgcctgcttataaattgtggtcatgaactcacttggagaaattaaataatctgatgacaaaaaattctttatggtattccgggtttcaacattgccatccggcaaatcaaaaccgagtgtctttaaggggataccatgccaggtattgacataaatctgtccttcttttggagtataaagaggtggaaaagtaacgttattaataagatattttgcactggccaattgttttaaatattcgtcatcactcctggagataaaatgaacattatcgtatgaagcatattcttcaattacctttttgttatcttccatatcttcaaatacccagtaatgatcatatttattaaaatcagatctgcttttaaaagttttaaaaatagcataaggattacaaatcattccccgtcccatataagattcatataaaacagcatgaggattaattttgctcttattataatattcgacataggcagcctgacggattttagcctcatttttattgtgcttgcttttttcagtatttataatatttgtaaaagtatttatctggtttttaaaacgtgaaaaacttgacataattcctcctgattttacttcatctcattttgttacatcttcttaacattttaacatatagcatcaaggaaaccaaactatattttaatgtagaaaaaacagaaaaagaatgataaaattataaaaaatattacgaataagtacaagaaaaggatagaacgatgaaatttagtaaagaggatacattatttatgaaaggactggccattttgattatgttttttcatcacagcttcttaggaccggaccgatggatgaatttgccgattaccttttttccatttgaaaaagaagcagtcgtttatttagcaggcttttttaagatctgtgtaggtatgttcgttttccttacagggtatggcatgatggcttcggcatcgaaaaagattaaaacaaagctggatatgaaaaaatatttgattaataggtatacatctcttatgtcaggatttgtgtttatttttattgctgtacaagtgttagcaattcctacaggttactttcaggagatttacggaaaaggtgcattgtcagtctgttatttttttattgatgcgatagggctctcacatctgctgggaacacctgttttttgccctacatggtggtatatgagtttagcaacaatacttatcattgtttttccgatatttgtgagaatgttaagggaatatgatatattagtactatttatatcatttctgcttccgtttgcattgaagctgcctatgacagactttattagatggatgccatgttattttttgggaatgtattgtgctgaatatgatattttggctaaaattaaaaatggatataataatcagaaatcagggaaaaaattaatgctgtttgccttggctgcaatcggcctgcttggtataataaaacttagacagcatccatttattggagcaaaatttataaatatttgggattgtttggctccggcttttgtaattttgataagttatctttttcttgtaaattttaaaggtttaaaacaacttttggtattctttgggaaacattccatgaatatgtttttaattcatactcttttccgagggatgttttttcagaaatttatttattcattttattatgcatggctggactatgccgttctgcttgccgtctcacttgtgagttcattgctcatagaattattaaaaagaattgtaagatttgacaaggtgataaacaaaatgaaaagccgcctttatttaaaattaggaatgaactaagattgtacggttgtttatgtatctgaaaaatgatataatttgttagttgtgataataaatatggagaaaaatgatgaaaacatatattgaaaattttaaaaagtacagatttttgctctatgagcttgtaaaaaaaggagtcaaattaaaataccggcgctcttatttgggaatcctttggaccttattagaaccattgcttacaatgatagttctgagcattgtattcggtacgcttttcggcaacaaagacccgcagttcccagtctatattctgaccggccgccttatgtacagctttttttcatcggcgacaaacggtgctatgaaagcaattagaacgaatgcggggatgataaaaaaagtatatgtcccaaagtatatttatccattgtccagtgttttgttcaattatattatttttgcaatatcactgatagttttggtggttgtagggattgtgctgaaagtttatccttctgtttatatgctgcaggccatcatacctttatttttgattcttgtgacagcttttggtgtggggatgattctctcgactatggcagtttttttccgggatttagaatatctgtggtccgtgggactgatgatcatcatgtatgcctcagcgattttctactatcctgagaaattactgaaatccggatttggctggattcttaaatgcaatcccttgtatttgctgattcataatttcagacaggctgtttttggtctgcctatgaatatgaagtttttagccgcatctgttgcatttgctgcagtaagtattgtcataggcttggttttcttctacaagaaacaagatgaattcatactgcatatataggagggtgtcatggctaagaataaagaagttttaaaagttgagcatgtaggaatgaagttcaatctgagtcaggaaaaagttgataacttaaaagagtatgttataaaattgctgaaaaggcagatctcatataatgaattttgggccttaaaagatataaattttagtctgaacaaaggagaccgccttggaattttaggattgaacggagctggtaaaagtacattgctgaaagttattgcaggtgtactgaaagcaacagaagggacggtagtcacaaaaggcaagattgctccgctgcttgaattaggtgcaggttttgaccaacagtatactggtcgtgaaaatatttatttatatggcgcagttcttggattttctaaaaagtttttggatgataagcttgaagaaatcatcagcttttcagaacttggtaatttcattgatgtgcctgttaagaactattcatcaggaatgaagtcaaggcttggattttccgttgccacattggttgaaccggatattctgattttggatgaagttttgtcggttggtgatgctaagtttcgcaggaaaagcgaagcgaaaattatgagtatgtttgacaaaggtgttacggtgctgtttgtctctcattctctggaacaggttcagagactctgtaacaaagcaattcttttggaaaaaggcaggattattgcaagcggtgacattggtgaagtaagtaaaatttatgaagagaagactaaataggtgctattatgctgcataaattaaaaagatttacaaagggcgataaggatgttatagatgtttacagagaggtttctcgcaaaaagtgcgtagatacctctttggtgttattggagggagctcaaggcaaaaactataatggaaatatgttttatcttctcaaggaaatagaacaaaatccaaagtggaaggataaacatcctatttttgtggctaccaaagatacggaaaaaaagactaaagagatcttaaaaaattataagttctttaaggcacaagttgttgttcgtaattcaaaaaaatatgcagaatatctcgccacagcaaaatatctgtttacggataattcctttcctacttatatggtgaaaagggaagaacaggtctatgtgaacacatggcatggaactccaataaaatatttagggatcagtgatctgaaaaatgccacatctctgccaaatgtccaaaagaattatttaatgtgtgattatgcactgttcccaaatgatcataccagagaagtgtttttagatgattatgatctcagaaattttatgactggcaagtgcctgatgtgtgattatccaagaaatgatgccttttatgatggaagtgcaccggcagaaaagataaaaaatattgcgtatttacctacatggcgcgggtcgggacgcattgcaaatgtaaaagagcaaaaaagaattgtcgctgaatttttaaatgaaattgataaaggtctgggggatgagcagatcttatacgttaatctgcatttcttagtaggaaatgatatggattttgaacagtacaagcacatcagatcttttccaaaagatcaggagacatatgactttttaaagaactgtgatatgttgatttctgattattcaagcgtgatttttgatttcgcagtatcacaaaagccaattgtattatatgcatatgatcaggagaaatatgaacaagaaaaaggaacttatttttccatagatgaactgccgtttccaattgtagaaaatgtagattcacttttatatgaaataaatcatgtaagggaaattgatacgaagaattttataaataagttttgcaaatatgcggacaggcattccagcagaaaattactggaattagtattccagggaaaagcagaaaatctttgtatacaagctgcacgattgaataataaaaagaatctttatgtatacggtgatacattgggtgatgactcacagaaatatttattagtcaggtatttaaaggcactggattattctgggtataatgtcatgctgggctttaaaggaaaactgtcttaccgtaaagtagagttcttaaagaatgaacttccgaaagaagttcaggtccatggattggtaaataattatacttttatggtaaaagaaaaaacacttctttggctgagaaagaagttgggagtcacgaattattcagacaggatcagaagtattttcgagtatcaaaaaaatcgtctttttggaaagatgaaaatagatgagtttgttcagtttggtgtggacggagaaaagatgattgatactttttcttccttaatatgcgaaaaaagtatcatacttcttccgtatgaagttgaaggatgtaaagttctacattcctcttttctctttaataaaaagcttgcattacaaaattttgatcgggttttagattggagaaaaaaggattttaaagaggaacttatagaaaaagaggaaaatgtcgatgacgcaaaaaagaagtttttcaataagacaatagagtattcagcgttatttataaaaacttttaggacacgattttattatacagcggtatctttggtccgttattattccgtaattgatgtcagccagagagaagttgaaattgaagctggtgatcaaaagctgcaatcttgttttttgtttaaaaaagggattccttggtttggtgacggcaaactaaatatttgtatttttaaaattcataatacaacgattgaaaaaatgaaactcagcagtacgctgcactggtgctgggaagacagagacggatttggatttaaaaagaaagtcatttatggacgcaaagaaaacggttataaaatttcagctgtcagcagatacaaagatattaaccggaccatttattatcgggcgaatgataatggatttctggcattgtctgtccggccaataaattttacggatgtcaattggcagagaataaaattatgggccgcatcactcgcagcaaaagctcttcagaagaaaaattacattttattatatgagaaaaattgttccagatatgaggagtcagcgtctgttttatatgaagaactcattgatcagaactataaaaatgtattttttgtcttggatgaagagtatctcaaaaaacacgggagtgaaattaaacaaaaatataaaaataatttgatttcaaagttttctcttaaacactatttcatgttttttgcatgtaagacatttatgtcttcagaaagtatagggcatgcattagaaacaaggtgcagcagcaaagctgtcaggaaaagaatcgtcaataaaagatttaactatatatttctgcagcatggtgttatgtatatgatttcgctggattctgtttccagaaagatgttcagtcagatgccgaaaaaagctaaggagtatagagttgtagtttcatctgatttggaggcagaacattttcttgattttggccagcacaaaccagagcatatatatttgacagggctatgtaagtttgataaaaacaaatggaatgaagatgcagacaggattgttatcatgcctacatggagaccatgggagtataatcaagcagttgaagatctttaccagacgaaatattataaaatgttggaaaggatggtatatgcagttcctgaaagtcttcggaagaagctgactctgctcccccacccgctcatctcagagatatttaggggaaatggaaatgaattcagtcagtatctgcctgaagctgacttgaagtatgataccattttacagaacacaaaagtgcttattacggattattcttctatttcttatgatgctttttaccgaggggcaaatgtaattttctattgggaagagctggaagaatgtctgaaggaatatggatcaaatacaaaactgatgttaaataaatcaaacgcttttggagatatatgctataatgaaaaggaactgtcacaaaagttgatcgaaaattttgagaatgggcaacgaaatgaatatatcggcaattatcagaaaatagtcgaatttcacgatggaaacaatacaaaacgtctgttaaaatgtttacagaaagataatattatttaggaggcaatttcatgaagaaagttatcacttatgggacgtatgatctgctgcatgcgggacatattaacttattacgaagagcaaaggaattgggagattatctaatcgtagttctctcaaccgatgagtttaactgggatgaaaaacagaaaaaatgttatttcagctatgatgaacgcaaaaaattattagaagcaatccgctatgtcgacttagtaattcctgaaaacaactgggaacagaaggtttcggatgttcaggagtatcatgtggatacttttgtcatggggaatgactgggaaggcaaatttgatttcttaaaagattattgtgacgtagtttatcttcctagaacagagggcatctctaccactaaaataaaacaagatttaggattgatggggaaacaaaaaggagaataagaaattatacaggaggtccttatgagtacacaaaaggtaagaaaagccgtaatcccggcagcaggtttaggtacaaggtttttgccggccacaaaagcaattccgaaagaaatgctgccaattgtggatgtgcccacagttcagtatattatagaagaggcagttgccagcggaattgaagaaatattgatcattaccaattccaacaagcattgtatggaaaatcattttgataaagattatgaactggaggcccgtctgagtgaatcaggcaagacagctcaggtgaagctgatcaatgatattgccaaccttgccaatatctattatgtacgccagaaggaacctaaaggtctgggacatgcggttctctgtgcgaaatcctttatcggaaatgagccttttgcggtactcttgggagatgatgtcgtgataaacaaaggcggacagcctgcacttcagcagctgatcaatgcttacgacaaacatcacgcctctgtcgttggagtacagacggttgcggaagaccaggtgagcaaatatggcattgttgcgccgaaccgaaatgtacctgctgatggaagagctgtaaaactggacaacatggtggaaaaaccgaaacaggaagaggcacccagccgtatggcagtgctgggccgctatgtgctgactccggaaatcttcgatcttttagagagccagggagccggggcaggaggagagatccagctcacagacgctatctgccggttgatcgatacacaggctgtctatgcctatgactttgagggcatccggtatgatgtaggggataaattcggatttatcaaggctaccattgattttgcactggagcgtcctgatctgagagatcaggtggcagactatctgaaagaaattgcagaaaaaatgaaataggtgaattgtgaaagaatttataaaaagtattttgatacaactgtataggatgatgaccagattcattccggtatccagaaatatcataatttttcaggccagcaatgggaaaaattatacgggaaacccacgctttatctatgaagaagccgtgcggtcaggattagataagaagtatgaatgtgtctggtttctgctggatgtgagcactgaagttccgggggaatgcaggaaagtgcggaataattatttaaaatacttttggtatttaatgagagctggggtctggatttttgacagtcgtcagcctctttattatataaaaaaaaggaatgtggtctttctccagacatggcatggaactcctcttaaaaaactggctttggatatggagaagttagatctcaatggaagcagtgatatcgaagattatcacagacaatttctaaagacgacgaaagactgggattttctgatttcacagaatcgttttgcttctgatgtttttcgcagctgtttttcctatgataataaagatattttagaaatcggatatccccgcaacgatattctgctcagggaatggaatgaagaaaagacaagaaagctgaaagaaaaattagggcttccgctggaccggaaaattattttgtatgcgcctacgtggcgggacaatgagttcagaggagacggagattttgtatttgctaccaatatggactttgcctgtatgcgagaggctttaaaagacgagtatgtgatgatcgtaaaatatcattatcttgtgtcagcggagattgattggagtccttattcggattttgtctatacatttgatgagacgaaagatattgcatttttatatctggcttcggatcttctcatcacagattattcttcggtgatgtttgattacagtctgctgaaaaggccaatgctgttttttgcctatgatcttgataattacagagaaaatttacgaggtttttattttgattttttggaagaagtgccgggacccgtttccagggacacagaacagctgattaaggatatcaaaggttattcttccgaagagtggacgggaaaataccgtgtttttgcagaaaaatatcaccagtttgagacaggaactgcttcaaggcaggtattgaaaaccttgggattggagtagcatatgctgaataaatttataggcagagtaaagccagcagtatctaaaattgaaaaaataaatgaccgggcgtactacgcaagatgttacagagagcatgctgtacaggaacaatggatcctttatgaggcatttgccggaagagggattttgtgcagtccaaaggcaatttttgatgcattgaaaagaagggttgaatttaaaggttatcggcatatatgggtacttgacagtatgaaagcccacaaagacctgatttataagtataagaatgatccttctgttatattcgtagaacgtcactctaaggaatatttaaaatatttagcggaagcaaaatacctgatcaataacagtacattcccgggttattttattaagagagaagaacaggtatatatcaatacatggcatgggattccacttaaaaagatgggttatgacatgcccggcggtaatttcacctctgccaatactattcggaattttctcgcggcggattttttgctgtccgccaataaatttcagtctgacatgtactggaaaagctataagctggagggactctggaacggtaaggtgatagagaccggccatgccagaaatgatgtgttttggagtgataatagagaaagtatttatgagcatttagacagtctgggtctccttggcagccggaaaaagaagatcatactttatgctcctacatggagaggagatgatttttcaaaaccaagaaaagaggctgataaatatctccactttattgaggagatggagaagaagctttgttctgatgagtaccagatccttgtaaagccgcatcagcaggtttaccatcagattgaggagcggtcggacataaaagggaaatttgttccgtcttcagtcgatacaaacgaattactgtctgtaactgatattcttgttacggattactccagcattttttttgatttcctggccacaggcagaccggttttgttttatattcctgatttagaagagtatgaagataccagaggattttatctgccgcttgaggaactgccgggacctgcttcaaagtctttgaaggatgtgcctcagtggatcacgaatatagaagatgtacagtgtgaatacagcacgttgtatgaaaaaaatgtccgctgggtgttagaacatgaggatgggcatgtttgtgacagaattattgatgcagtgtggtttggaaaagatcagtctgtctgtcagcaaagggtgacagaaaaaccgaagctgcttttgtacaggggcggactgtctgagaatggaattaccagatcctttatgagccttttaaatataatcgactatgataaatatgatgttaccataggcgtagaatatcccgggattataccgggggacatggaaaagctgctttccttaaataaaaacgccaggtgtattgtctatatccctgaggcgtccggcacatggaaagagctggtcgccaggaaaaaaatattaaaaaatggggtatataatgatgaacagtgggagaaagttcctgttgaattttttaaatgggattttcggcgtacttttggcggcagtcagtttgatgtaattgtggaattcggaggatactctcctgtatcttcttatctgcttcttcaggccggaaacggtaaaaagattatttggcagcacaatgatctggcgctggatgcaaaaaaagtaatccatggcgttaagccgcatgaaaaaaacctgaataccatattctacttatataagtattatgataagatcgtaagctgtgggaaatatgtgatgaaacagaatatgaaaagttttgcgactagcgggacgtttcacaagtttacctatgcaagaaatgcattggatattggccgcttagaaaatgatctaaagcagaattccatatcgggaacagacctctatgggcagacacgagaatggcctgatgaaaaatatataaattttgtgacaatgggaagaatgtccacagaaaaaaatcaattgaacctgcttcgcggttttgcaagactgcaggagcaatacggaaatgtaatgcttcatattctcggggacggacctttgagagaggaaatgatgcaggaaattaacgaacttcagataagagataaggttgttttgaccgggcagatggaatatccgttttcttatatgaaaaggtgccaatgctttatcctgccctctctttatgaaggacagccgttagttttatatgaggcgagagctctgggacttcctctgatcatctctgagttttcctctgtatctgacagtattacagagggaggccagtatttgatcggaaacagtgaagatgaaatatatgaaggaatggaagcttttatgaaaggcaaggttccggaatataatttctcagcagatgagtacaattcagaagtatttcaagagtttgaaaaggctgttttgggataaaagaaggaaagaacaaggagaatatacaatgagagttagcgttgttgttccttttcataaaggaattcattatttagaagattgtcttgagagcctgtctaaacagacgataagagaatttgaagtgattttggtaaaagatcgtgtggaagaagagattgaccagacggttgcaaaattccgtgataaaatggagataaaagtagtatccaatgaaaagaaatcgggagcagcagcggcgagaaatcttggaatccagaattcaaaaggggattatatttattttctggacagtgatgactatatacaagatgatactttagaatcgctcatgaaaaaaatgtgtgatgagaaggcggatgccgtatatggaaaaacaaaatacacatggctgaattatcataattttttcatcacagaagaagcggaatatgaggttcaggagtataccggagactggaaaaaagacttgatcctacaaagaccggaattccctttgattacggtctgcaatatgcttgtaaaaaaaggcattctcttcgatgagaatctacagatttttagcgatgtaccgtatttatcaaggatagtgaacagcagtcagaatattgtgtactgtgaagatgctgtctatataaaaagaagacacaacgatgaaatacaatttccgtcattatcttatggagacaggaaagattattgggaacaattaggacaatctctgctgaaaatgcaggaggatgtttcagcagatgtgaaagactctgtggataaaaaattgtttgagtatttatctgagaaaattcagaacatccggcaggacagggcagaaacctggcagaaaagcatttttttaaatttacatttatatataaaaactatttcagaagagacaataaatggcatgtcaaaaagtgggcgcttgctggccagagccggcaaagcggatgagatttctaaatggaaaagaaaggcgcattcgatctggaaaaaacggaagttgatccgtgtcctccaggaccgttcttatcgtatgcagacaataacccatatgttttttcaaaaattttcacagaaggacaactggattgtgtttgaaagctttttgggaaaaaattattcggacagctgtaaatacatttatgaatacctgctgaaacattatggagatcaatataaattcatctggattgtaaatgataattctattgagattccggggaatccggtcagaatcaaacgtttcagtttcaggtactattattacatcacgaggtcaaaatattgggtgaataacatgcgtcagccgaagtggtttgataagcgaaaagagcaggtctttttagaaacctggcatggaactcctctgaaaaaactggtttttgatatggacgatgttttttcggcaacaccaaagtataaaatgatcgtgtattcccagtccaggaattgggattatttgatttctgataatcctttttctacggaagtttttcagagttgttttttatatgacaaggataaaatcctggagacgggatatccgagaaatgacatcttatatgcgcccaaccgggatgagttggcagcttccgtcaaagccaaacttggcataccaaaggagaagaaggtgatactctatgcacccacatggagagacgatgaattttatgaccagggagaatataagtttcagttaaaattagatctcaagtatttgagagaagaacttggccaggaatatatggtattgctccgcacacattactttatcgcagattccattgatgtgacagggatggaggattttgttgtaaatgtgagcaaatacagtgacattgcggatttgtatttgatttcggatatctgtattacagactattcttctgtatttttcgattatgcaaatctcaggaggccaattttattctttacttatgatctggaaaagtacagagatgttctgcgcggattttatatcagtatagaagatgatgttcctgggcctctgctttttacaaatgaagaaattgtggatgcagtaaaaaacattgacaagatagaagaacaatacagagacaaatatgatcagttctatgagaggttttgctcattcgatgacggacatgcagcagagcgcatcgtagaacgtgtattcaaaaattaaaggacttctatgatgaaaagaaaatacaaaaaattacaaatggataaatatggacgtgttttgtgtgctgtgttgttaacggtttattttatctttgcattgacacagtccaatgcttttaagggagaaatgttcaatgccttaaaagttcaacatgagaaaaatgaaagtattcataaaggatgggagaagtctgtagattttaaggccgattatgccgatttacagcgtctggagatgagtatcatcaatcccaggggaagtgccgcagagggaacgatgcgcttttggatcacagatcagggcaaaaaggttatgtggcaggaagatgtgccgatgagccgtcttgcagaagcgaaatttcacaagggaatccgtggtaccgttataacaataaaaaaacagctgcagaagggaaatgattatacacttcatttgagagtactggagggcagtgaaagtcagggaattaccttaaagagcaaaaatataacaatttactataacggctttaatgtgaagaaatatgttatgctgctggcatcagtccttgctctctttatcctgatatttattccaaacaggcttaatgaaaaatggaatctgtggctcagccggggaatgtttctcataacaccagttttttgttatgttctgatggagagatttacatcggtttctcttaaatatataggtataaaatatgggctgttgaatcttttgatttatgctgcggtgctggcattcttctatttgatcacgaaccgcacacgatgggcttccatattatcgatactttgtacatcgggtctgggtattgcaaattattatgttactagctttagaggtacatctttgatgccggtggattttgccacgattggaacggcggcgaatgtggctacccagtatgaatatgacgtcaacacggcagtgttatggaacggagtactgatccttgcttttgtgattctggcagtcaggctgcagtgcgggaaaggtatacgggggaagaagcgctttgtccctgcagcggtgtttggagtactccttgcagtatgtgtttccgtttttggaagtacggcccgcttaagcaggctgggtattcatataaaggtttggaatcctactgtgagctgtaataaatatgggtatatgaatgtattcacatccagtgttaagtttctgatcaccgaaaagccggaaggctattctgcagaaaaagtagatgagatcatgaaaccttacgttgaaaaggcagagaaacataaccaaaaagcagctggtaaaaagcctaatgtaatcaccataatgaatgaagcattttcagatctgtctgtactgggagatataaagaccaataaggattttatgccgtttatcagaggattaaaagagaattcagtaaaaggtacaatgtatatgtccagttatggagggcagacggcaaattccgaatttgaattcctgacaggcagttccatggcttttttacctggaggatctgttgcgtatcaatatcaggtgaaagatactatgggaagtcttgcgacaacgatggaagggcagggatatcaggggaatatggttttgcatccctatttgtcaaatggttataatagagaaaaggtatatccccttcttggattcaaggattacttatcaataggagattttcagaatccggaagtctgccgcagctttattacagatcaggaagactttaacaagattacgtccgagtatgaaaaagctaagcaaaaaagcagcgctccgttttttatgtttaatgtgacaattcaaaatcatggcggctatgagaaagattattcaaattttaatcaggaaataaagattacggatacaagcagtaatccgtcggcaaacaggtacttgagcctgatcaaaaaaacagatgatgcctttaagaatttaatttcttactttaaaaaggtgaaagagccgaccgtcattgtaatgtttggtgatcatcagccaaagctgccacaggaattttacaataaggtgatggataaagagaatggttccgcccttgaaaatgaacagaaaaaacatcaggtgccttttattatatgggcaaattatgatatcaaagaagaagagataaaagcaatcagcccgaattatttgtcggcaaagttactgaaggtaatcggaggcaaaatgactccgtatgaatgttttcttcaagatttatacacaaagtatcctgtcgtgacaggaagtgtttatatggataaaaagtataatctttttaatattgacaatctggatgatctgccggaggatttaaaacagtactggatggtccagtactatcatctgtttgcaaaggataagagagaagattctttatttttcctgaaggagtaggagggtagggctatggttacaattctgttagcaacatataatggagaggattatttgaaggctcaattagaatccattgcttcccagacatatggaaactggaggcttgtcacaggagacgacgggtcctgtgacgggactctgggcatcttggaggattttagaacacgctatccggaccaggtgaaaatcataaagaacgagcctgccacaggaagtgccaggaacaattttattaatcttctgagaaatgcacacggaccgtattttatgttctgtgaccaggatgatgtgtggaaacgggataaaatttatgagacgatgaagaagatggaggccatggaggaacggtatgggaaagatacaccgatcctcgtacacacggatctttcagtggtggacgaaaatctggagatgatcgcagaatccttcttccagtatgcaaacctgcccaaaagaattgcattaaatcagctgatcgtacagaattctgtgaccggatgcacggcaatgatcaaccgggcacttcagaagtatttcctgcagccgcttcctatgggtaaaatactgatgcacgattactgggcggctcttgtcgccaagattttcggaaggattggttttgtcaatgaaccgactatgtattacaggcagcatggaaataattccgtgggagcgaagaattcaaagaatcccgtgtttttaatgcagagactcaaagagggcaaagagtcttaccggaaacagatgatcaaatctatggagcagatccagggatttgtagaaacctatggggaagagatcgaaggcctggatgaatataatcttctgaagacttatggaaatctatattataaaggaaagatgcgcagacttttcttctaccggaatcatcaggttctgaaagaaggaaatatccgtaagctgatgcagtggctgtggggttagggtgagatgaaaagtggtatgaagcttatactgaaatatattgtgatgtacttgtcgtgtctctggcccaggagcagaaaggtttgggtattcggcgcatggctcggacagcagtttgccgacaatcctaaatatctgtttattgaggcaaatcagatggacggaatccggccggtctggatcacgaaaaatccacgtgttgtcagggaagtgagagagttaggttatgaggcttacctgttttctgaacggaaggggattctctgtcagctcagggcgaaatatgcggtgatgtgcaatggaatcagtgatctgaatcatgcatttctcggaagagccgtatttttgaatgtctggcatggagttccgcttaagaagattggatatgatgataccaagggaaaagactgggacagcaggggacagaagatccggcgtaagattcagcagtttcctctgggaagagagtatgtggtggctacgagccggactttttccgagatttataagagtgcgttccgccgtccggcggagcagatccttacttatggacagcccaggaatgattttttctacgacgataaacatctttttccggtgaatgaaaaactgaggaagcggcttgaaggtcaaaacgtgattctgtacgcgcctacacaccggcaggaaggaaagattccgtttcctttaagggagcattttgatttaaaaaagctggatgaattctgccgggatcatcagatcctgtttatcattcgcagacatttttatcatattcatgaggaggcagatctttcggattattccaatattgtggatatgacaaaggattcgctggatattcaggagctgctgatagaaacggatatactgatcaccgattactccagcacatatattgactatctgctgctggaccgcccggttattttctatgattttgattatgacagctatattgaaaaggacagggagatgtattttccttatgatgaagtgacaccggggatcaaggccgggaccttcgatgaattaatggaaggcatgcggcagatcgtctcgggaactgatgattttaaagcagacagaaaaaaagtcagggatcttttttattgtaaaagaggacagagagaagtgggcagggcgcttcttgagaagatgcagcttttgtagatgatacgcaggctgaaaatttcatatgcagaaaaagagacagcgaaaagctgattctccgtagacaaaacggaggatcagcttttttcttttgtttcataggcaagactttgtttttgctctttcctatccgatgggaaatagtctggttgagtggaaagaaaggggcatggtattcttgagacaagataagaggaaccatacagtaaaaaaggaggagaaacatatgagagcggctgtctattatgcaccaaatgatttgagaatggaagacgtggaaacccctgagccgggaccgggggaaattttgatgaagaatatttcggcgctgacctgcggaacggacttgaagcagtacaaaagagggtatccgaaattcaaagaagggcagaaactgatttttggacacgagagtgccggagttgttgccaaagttggggagggagtaaccggattcaaagtgggagacaggatcgcacctcacaattctgctccgtgcaataaatgttattactgtaagatcggggaacacagcatgtgtgaggatctgaccatggtaaagagtgcctgggcggagtaccggcttcttcctgcggccatcgtgagagagaatgtgtttcatattccggaccatatttccttccgttctgctgcgctactggaaccgctgggcagtgcggtccatggaatcacagatgcagatattcagctgatggatactgtagtgatcaacggggcgggtcctctggggcttatgatgacaaagcttgcaaaactccggggtgcttatgttatcagcacagataaaaatgcaaaacgccttggggtggccagggaactgggtgctgacgttactattgacatttctgaaacagaggatgtagtggaggctgtcaaagggctgactccttgcggaagaggtgttgatatagcgatcgatgctaccggggtccccgaggtttgggaaaaaaatctttacatggtcagaaaagccgggactgtccttgaattcggaggatgcaggggaggaagccggatcacggtggacacgacacttcttcattactcccagctgacagtgaagggagtctaccatacgacaccgaagcttgaggaacaggcattcagactcattgaaagagggattattagcgaggatctttttgtaaatgatacatatcccctggaacagtgtctggatgcgctgaactcccatgcgggaggagaagtcatcaaaaatgaaatacgctgtgacttatagagataaaaaattgtgaattcaaggaggaaactatggaaaaagagagagccaaagaacaggtcattcaagctgctatcgagtgcagtgacaagaagctgatccatgggacttcgggaaatgtttcgatcgcctgcagagaagagggggtcatggtgattacacccagcgggataccatatgaggagatcacaccggatatggtgccggtgatcgatcttgccacaggggaatggacagagggaaaatgcaaaccgtccacagaagcaccgatgcaccgcctgatttttctgaataaagtaaagatggaagcggtcgtacatacacattctccttttgccaccgccatgtcgattctggtggaagagcttccggcggtggccgctgcttctgcaccgtattctccggtaaaagtggcaccgtttgaaataccggggtcgcaggagatcgcagaagaggcagtgaaggctatgggtgatcacaatgtagtgtgtttactggaaaatcacggtctgatcgctgcgggaagaaatgtctcccaggcgatgagcattgcagaatatgtagaggaaaattcacagatagcatattacacctatgcggcaggaaaaatgaagcctttaccggaatcgggctataagatcatgcatgaccgggcagtaaagaagcttggattagaataagagagacaatttattaagagtggaaaaaaatacctgaaggatgagcggaactgaggtgataagataaaaaaaacagtaatgagagggtgatagcaatgataggactgccgacaaggcaaaagaagatattaaaaaagctaatgtctttggacggctgggtaaaagggaaggaacttgctgaggagatggcggtgactccgagaaccatccgggcggatattgcagcaattaatgtctggctgaaaaccgtgggctgttatatagaatcttccagacaggagggctaccggctgcggggagagaggcagggggagctggaatctttgctgtgggatggtatggatgtgcctttgacaccgcaggagcggatgcgtgcccttgggatcagacttcttcaggcggatgaagagaaaccggaggatgtggatgagctggaggaagaaatgttcgtcagccggacgaccctggaaagcgggatttttaagatcaaagctatgctggagagccgcacgacaccaatgtatgttaagaggaacgggagaaagatatggacttacggggaggaagagacgagaagatttcttctgaaggaactgatggtagaccggacggacccggattatctgatgattgagaattatgacgattattttggggctgacataccggaaaaaatgatgaactgcgtgctgaatgcactggcggacaatgaaatttccatgacagcggaggatatccttcatttggttatttatctgtcgattaaacttacaagagtccatatggggtatgaatataagaataaaacaaaagatattctgacatcagaggatatcaactggacacttgcggagaccatttcagggaaagtcagagaagaattctccacagaattaaatgaggaagaactggtggatctggcggttcagctttctctgtttcggctgatcggaagtgaagcagaggtcaggccggcgccgatacccgagcagtcccactatgaatttgtggtcaatgaactcttaaatgacattaaaaacaaatttcatctggatcttacggatgatcaggagctgaaggcagggcttgtgacccacatccggtatacattaaaaaggatcaggatggagccggagagcaccaatccggtgctgatgcttttaaagacagaatatccctttgtgtttgatatgtctctgtttctatacgaacggttttacgatgtgttcggagtgaggctgaatgaaaatgaactgggatatgtggccacttatctgggaagtgcggtggagaggatggagagaaaaaaatctccgaaagattttacgattgcagtcgtcacaggaatgaattatgggacaagcaggcttttgactacaagactgaaggcgatttacggtgacatctgcaatattgaaggtcctttctctatctatgcagtcaatgagatagaaaaattaaaacctacttttctgattaccacagaatcaaaacaggtactgaaaaactttcaggtaccgaaaatacagatttcgcctctgctgaacgaaaaagatcagagggagatcaataaatggcttctgcagatgcgtaaagaattgatgtatgaccagcttccgaggagcattaaagattattttcacagagaactgtttttttataatctaaaggctgagacgccggaaaaagttatccggacaatgtcagaacatctcataaggcttgacttcgcaggagaggatttcgcggaaaagacgctgatgagagaacaggtggcctctacaatctttggaaataagattgctatgcctcatccgatcgaagcatgtgcaaagaggacggttatcagcgtgggcattctgaatcagcccattttatggggcagcggtcaggcacagctgatctttatgctggcagtgaaaaaggaagatatgaagtatttaaacagcttctttgacttgacggtgcgcctggtggatgatgagggtctggtaaggaagctgctgggttccgaaaacctggctcagtttaaagacagacttccgattttatagagaaaggaaagaaagcatatgaatttaaaagagttgatttgtccgaagctgattctgtgtgatgtcgatgcaaaggatttccaggatgccttaaggcagatggcaggacatttaaagaaagaaggatatgtggaggaaggatatctggatatgcttttggaaagggaacggaaattccccaccggactttgtaccaaaccgtttgcggtggctctgccccatacggagcctgaccacgtgataaagccgtgtatagccgttgccaagcttagaaggccggtagaatttcatgaaatggtgaatgatcagaacacagtcgacgttcgttttatttttaacctggtactgcagaagacagagcagcagctggaactgctgcagaagatcatatcaattttctctgataaggaggcgatggaacagctggagaaagagcaggaacctgagaaaatagcagagattttagaacatacaaaaataggaataaacacttaaacatcgaaagaagggagaaaaattatggcaaaagtatttaaggttttgtctgcctgcggcagcggaattgcaacttcctctcatgtggcaacttccatccggcaggggatggcagaccggggagtgaatgttgaagtcaggacctgcggagtaaatgagatgtcaggattgatcgacaacgtgaaaccaaccattattgtttccaccacttccttagaatctgtgagaaatgtgggtgagattaaagtcatgtcaggggttcccctgctcacgggtattgggaaaaatcagttttttgatgaaatggaagaatatttaaaaagtatttcataacaaatgaaaaggaggattgaatatgggcgttatcaatacgattttaggtcttggggcatctgtgattatgccgatcgttatctttcttctgggagtggtcttccggatgaaggtaaaaaatgcgctgagagccggacttacggtaggaatcggatttaccggcataagtcttgcaatcagcctggtaagcgacaatcttggaggccttgtaaaagccatgcaggcaaactggggactggccctggatatcacggatgtaggatggcctgcggcttcgggcattgctttcggaagcggaacctttgtgctggcatccatcgtgacattccttatagtcaatgtgatctgcctggcaattaagatcacccacacgctgaatgtagacatcttcaactactggcactttattctgatcggaactgtatcttactttgtcacagggaacttcattctgggtattgtcgtaggtacattgtttatgatggtcaatacgatcttaggagagagacaggagcaggtgatcaccgactttgcaggagaacagatggccggtctgaccttctccacacagggattcccgcttcagctgttattcgccagaggcgtggactgggtcattgataagatccccggtttaaacaaaatttcttttaaccttggaaatttgccgtcaagcatctcttttttcggcgaaccgatgattttgggatttttgcttggaggtatcatgagttttctcgcaggatataaatgggatgcggctctggtcgtagcagtcggactttccgctgccatgttcctgcttccgaggatggtctccatcatgatggaaggccttgctcctctcacggatgcagccagagactttatgaataccagatttccgggaagaaagttcaacattgctatggattactgtatgcttctgggagacagggacgttatcactatgggaatcatcactgtgccgatcgtgctcggactggcaatcattcttccgggaaacagatttcttccgtttacagaccttactgcccttccatactggatgatcggtgttgtcatcggcacaaagagaaactctttcagggccttgattgctgcggtgctgacactttgcatcggcctgtggattgcgacagacctggcaccgctgatcacacagatggctgccggcgtaggatttaagtttgaggccggaactaccatatcaggattttgtgtaggacaggaatgggtcggatacatcatacataagattgtttccttcttctccggaatgttctagacgaaagacaatacaagataccaaaatattttctatatagttcgctggaaagggattgtcagggagaccgggcggtcccgttcctttaaggagagaaagggaggttttggcatgttagtttcaatgagggaattgctcgtgagagcaaaagatgggaaatatgcggtagctgcagcaaatgtttttacggggagaacggtggaagcgtgctttgcggccgcatcggaaatgcaggctccggtgatcatagcctgcacgccttatgtgcagatggaggagctggccatggcggtacggttgtatgagaaaaaatacccggaggtaacggcagccctgcatctggatcacgggaaagagtatgaggatgttcagcgtgccctgagatgcggttttacctctgtcatgctggataaatccacacttccctatgaagaaaatgtaaaagcagtaagagaggctgtccgtgcggctcatgcagtcggtgtaacggtggaggcagaacttggacatgtgggaaaaggggcagagtatgaagagacaagggacagcgggcttaccaggaaagaggaggccgctggctttgtgaaagaaaccggggtggactgcctggctgtggcggtgggaacatcccatggagtttacaggggaaaacctcttttaaactttgagctgctctctgagctgagcagagaagtatccgtgcccctcgtgctgcacggaggttctaatacgggagaggaaaagctgaagaaggctatcacccttggaatacagaagatcaatttatctacggatctttccacggaatacttaatcggggtgcggaagtttgaagaggaaaatgatccgctgttcgacaatgacggaaaacttatctataccggaaaccggacggtgtacgccaaccaggcactggcagcgggggcagaagcctataaacatattttaaaaacatacatgaaaacgtttggaagcgaaggaaaagcattggaatgagagaggagacaacatggaaaaaataaaagctgccgtgagtatggaactttggccggaacagttgaaagagctggagtcctgctgtgatgtgaaaatacttccgtggacggccacggatatccttcccacagaggaagagatcatagaagaatgttctggctgtgaggcggtgctgttttatactgatccggtgacagaaagagtgatcagggaactcaaagaaaaagggttaaagctgatcggctgcggaagggccacgcctaacaatattgacacgaagactgcaaaagagctggggatcccggtcatccacgcgccgggaagaaatgcacattcggttgcggaatataccgtgggaatgatgctggatatctgcaagagaatttcctttacctatcacggtctctggtccggaagatttttggcagatgaaaaagacatttacgatgtgccggataaaaaggacgtgatctggcggtttaaggaccgggagaatccgagatcctcctatccgtggggaatcgatgtatacggccggacagtggggatcatcgggctgggccatatcggacagaacgtggcgaagatctgttccggcatggggatgaaagttgctgcttatgatccatttcagccccaggagacgtttgatgcggtatgcgcgaaaaaatatgaagatccgatccggatgctgccatcatgtgatttcgtcagtgtccatttgagtgtgacaccggagacgaaaggcatgatcaatgatgaatggtttaatgccatgagagaggacgcctattttatcaattcgtccagggctgccgtagtggatcagaggtcgctgatcgaggctctggagaacaaaaagattgcgtttgccgcggtggatgtcatgtgggatgaaccggcgccgaaaaatcatccgttttttacgatggacaacgttcttctgacgccgcatatggctgggatcagcacagattctaaaaaatgggcatctgagatgatagcggaagatctgctcaattatgtacgaaaacagtcgctggtcagagtttggaaccggtagaagggaggcggatactatgaattgcgtgagaactgtcctgggagatgtggacgcagaaaagatagggtttacctatacgcatgaacatgtctgctgcaatccgtatacagcagagaaggatcccactctggcaattacggatatagagggttctataagagaacttcgcctgtttgccgaagccggcggttctgctcttgtggagggaacggctgccgattacggaagagacccgcaaaagcttgtctatgcaagcaggcagagcggagtgcatctgattgccaccgccggattttatctgtttgaccacaacccggattttattgatgatatcagcacagaggaactggcagaactgtttataagagagatagaggaaggtatggacggaacggagatccgggcaggacagttaaaatgtgcggtatccccccggtttattcatccgagggaagagaagtgtctgagagctgccgccagggcacagcagaagtccaatgccccgatctggattcatcacggagggatgatggggatagaaattctgagacttctggaccgctgccaggcggatctctccagagtagtgctcggacatatggaccggaatccggatccctatgaatataagaaaattgcttctatgggaagcttcctgtctgtggacaacatcgcaagagtttaccgctatccggtccagactaacattgatatgattttggatctgatggaagaaggttatttggaaaggcttctgatcagcgcggactttggcaggagcaattatttcagggccaacggcggcggaccgggtcttgagtatattttaaacaagtttattccgaggcttaaggagtcgggcgggattacagagaatgaaatccggaccatttttgttgaaaacccaaaaaaggtatacggctgtttttagccaggacggagggacctgatgtatcagaaacaaacagtgataaagggaaagacaattgcatctgcctttataatggcacccatggtgacgttcggctatggggttaaggacggaataatcacggatgagctgatctcccactatgaggccagagccaggggcgggatcggaatgatcatcgcggaagcagcctgtgtggcagaggacggaaggctttctgagtatcagacaggtatatggaacgaggatcagatggaggggcacagaatgctggtgtccgcagcacacaagtttaaagttccgatactatcacagcttcaccatgcgggcatacggacagtatcgggaaggcctgcctccccgtccgcatttcatgggacactcaggggaagagaatatacggcagacgaaatgagtgaagacgaaatcctattgagagaacagcagtttattgaggctgctgtcagggccagggctgccggatatgacggagtcgagcttcactgcgctcattcttattttctgaatgcatttttatctccgacagtcaatcacaggacagaccggttcgggggaaacatcgaaggaagaatgagggttgtacttgatatcatggagggcatccggcatagctgcggtgagaattttctcatttccgtccgcctcggatttgacgagccggatctggagtcatctgcatttatggcggggacgtttgaaaaagccggcatggatttcctgcatgtatccacaggcttcgggtctacgggctttatggatgagaggaccatggagaatcctcctgacgaatttcccttcaatatccgtatttggggcgccatgcagatgaaacagagagtaagctgtcctgtaatcgctgtgggcggaatccggcaggtacaacagggaatgtttttgctggaacaggaatgtgcggattttgtggcccttggaagagcgctgctctgcgaccctgaatgggtaataaaaatcaaacagggaagggagatcgtatcctgcagaaactgccggaaatgtctttggagcacggattatcataaatgtccgggatggagggaatatcatggataaaaatacagtgaaaacgttcaggttcggcgttctgacatcgaagggacatgctgaagtacatgaaatgaagctgccgaaactgggagaacatcagatactgatcaaacagctggcctgcaatatttgtactgctgattacggacagtggctggggctgagagaacaccagggctatcctatggcgggcggacatgagggggcgggagttatactggaaaccggagccaaggtagtggagctgctgccgggggattttgtagccatctccaataactactgcggggaatgtgaacactgcagaaaaggggaagaaagccagtgcgtgatccggagctcctatgaccttcatgagggcgggtataaaggaagaatgggatttgctgaatatcaggtaagaaatgctacggcagtaatgaagatgaatccggaattaagtcccggggaggcggcttttttagagcctctggcaaccgcagcaaagggaataggaaagctcagagtaagccctcaggatacggtggcagtcatcggggctgggactatgggacttttaaatgcccaggcagtcagggcgtgcggtgccagagtgatcgtcactgaaatgatggaaaagaagatcaaaactgccaaagccatgggatttgaggtgatcgatgccggcgccgcagacccggtggagagagtgaagcagatgacaggaggccggggcgcagatgctgtcattgtggccgtcggagccacaaaagccaatgaacaggcggcggccatactcaaacattttgacggccggatgctgatgtttgcagccgcttatccggcccctgagctggggattagttctaatgacatccattaccgaaggatggagattctgggtacatatttgggcgatacaaaggattttctggaagcggccagactgctcaatcagagagtggtggatgtcaggcctctgatcgaggccagttatccgctggaagatattcagaaagccttcgaggaggccgcaagacccgggaattacagggtcagtgtcatgctccatgagtcaggcagagaggaggggacatgctcaaagtaggacaggagggatttttttataaatatgtaacggagcgggatgtgaaaatatttgcagaagtatcaggagacaaaaaccctctgcatctggatgaagagtatgccaaaggcaccaggtttcatgggcggattgcccatgggatgatcggagccggttttatctctgcggccatcgccggtgtcctgccggggccgggaaccgtgtacctgagtcagatgctgaattttgaaaggccagtgaggatcggagaccgggtgactgccaggatcaaagtcctgaaaatcgagaggaagaaatcatttgagcttgcaacactggaaacaacctgtgtcaaccaggacaatgaagttgtcatcagcggaacagcgcaggtaattcctgcgggggaataggaaggagaatttatgcagttattgagactggtgcccacggtattttattttgacactgtaaaacagtttcaggaagaatttaagatcggccacagtgatctggtagtgacaaacaggtatctgtatgagccgcttctgaaaccgctgggtgtgaacgctaattatatttttcaggaggaattcggagacggagagccatccgacgagatgatcgaccagataaaagagaagacgtcgaagtattattataaccggatctttgcactgggagggggaacgatactggatatcagcaaaatactggcattggatatgccggacggcagcactccgctgtttgacggcgaaaaggagcctgtaaaaaagaaacagctgatcgcagtgcccacaacctgcggcaccggaagcgaggtcacgaatgtagctatcgccgaaataaaatccagacatacgaaaaaaggcctggcagcagatgcctgctatgcggactgtgcggtcctgataccggaaactctagaaagactgccctataaggtgtttcttaccagctcaatcgacgcttttatacatgcagtggaatcctttctgtcgccgaaagcatctccggctacggagctgttctccgggaaagccatagaaatgattctgtccggttaccatgatatggcggagtctggaagagaggcaagaaaaaataatttgaaaagctatatactggcctccaactatgctggcattgcgttcgggaacgcgggatgtgccgctgtccacgcactgtcttactcgattggaggtgcattccatgtacctcacggagaagccaattaccagttttttatggatgtgatggagctatatgaattaaagaaaccgggaggaaagatcagaaagctgagacagaccatcgcggatgtgtttggatgggaggcggactcggcatttctaagactccgggagcttttgtcaaactttatggagaccaggccgctgaaagactatggcatgacagaagtacaaatcgaagaatttacagagagcacggtacagaatcagcagagactcttaaagaataactatgtggaactgacaaaagaggagatcagagagatatttaagaggagatatgatgagagataagaaggacaagccgtggaaagcggagtacagggagaagctggtcagtgcggatgaggcggtttctcatatcaggtcagggcagcggattgttttttctcatgcggcaggggaatctctggtcctctcggatgcccttgtgagaaacagagccctttttgaaaatgtggaaatcgtccatatggttgccatgggagcagcaaaatactgtgaacccgggatggagaaacattttcgccataacagtttttttctgggagcttctacgaggaaggccgcaaaagagggcagggcggatgtaacaccggtttatttttcagaagtcccggagcttttccggacaactctccccgtagatgcagtgtttctaaacctctcgcctccggatgagcatggttactgcagtttcgggatatccgtagattattctaaaccggcggctatggaggcggaattggtgatcgcacagatcaatccctctatgcccagaacgctgggtgacagttttattcatataagtgacatagattatattgtggaggcagatactcctctgatcgaacttccgcctgcagggatttcagaggtcgagagggcgattgggaaaaactgtgcctccctgatcgaagacggggacacgctgcagcttggcatcggagccatcccggatgctgtccttgggttcctgaaggagaaaaaagatctcggaattcattcggaaatgatctcagacggcattgtggaactttatgaggccggggtgatcacaaaccgcagaaaaagtcttcatgccggaaaaagcatcgttacctttcttatgggcacgagaaagctgtatgacttcgcggacaacaacccggcagtggagcttcatccggtggattatgtaaatgatccgtatgtcattgcacaaaatgaacgtctggtatctgtcaattcctgtgttcaggtggatttgatgggacaggttgtttcggcttcggtgggcaggagacagatcagcggggtgggaggccaggttgactttgtgaggggcgccaatatgagccggggaggaaagagcatcatggcgatgccgtctacggcggcagaaggcaggatatcaaagatcgtaccggtgatcggcgagggagcggcagttacgacatccaggtatgatgcagactatatcgtgacggaatatggaacggcgagattaaaaggtgagactttaagaaaccgggccaggaagctgatccggatcgcgcatcctgactttcgccggatgcttgcggaagaatatgagaaaagattccgggaagcctggagtgatgacgaataaagacagcctgtatcctgatgtattaaaaggatacaggctgttttgacgaacagttctcttaatggaaagaaaagcagtttaatattctgtaaagtattccgcaagctgaatgataaactgactgtttgtaggacgttccagtgtgcatgtctgagttatgctccagaataattctttgtttcccttgctccatacagtgtcgatggcatggcggatcgtcctctctacactggtcgacgtagtgtgattctgctctgcaatatgcggatacagacgttttgtgatgccgtcaaaaaccgaaggatcccgcactcctatttcaattgcctgtctcaggtagaggtagcctttcagattcggggtgatgcccagctgttttaaaagcttgctgatctttccggagaggtccaggtgctgggttccggaaactgtctgatttaacagctgattaatgtgaatcacgtgagatgtggtgtcagatataggtgccctatcctttgaatggatgaccgaaatttgtaaaattgtatcatctgacagtaccaattgaagattttcgttttgcatgatatactcccctcataaagataatgttgattccttagattatgtaatcatgttcattatagagaataatgaggaatattgtcaacttgtggagcaatggatttattccatatttggaaggttaagcggatgaattataaaaaactgaaggaaattatgcagtcaaaaaattttactgtggaagacctgtctacagccagcaggattccgatcggaactttatcaaaaattgtatgcggcatcacacctaatcccagatataatacgatggaagaagtggcgtcctccttaaattgttctctggatgagttttccggcagggagccgatggtgccatacagttacgaggattatattcagaagttcaagcggctgccggcgcatcaaaaagaatatatcaaatatgtgatcaatttggaatatgacagaatggtttctctgacatcgtcaggtaaaaaatctatgaagtgttttgaatttaccagcgtggaggatggactggccgactatgggagtcagaaagtacatgatgtatgggtggaacagaatccgcttacaagggaatgtacatttttcgtatgggtgcgtacaagtaatctggaaccgaagttctgcagaaattcagttctgggttttcaatacctggatggacgtctgccgaagcacggagagatatggatgtttcttcggtccggatatttatacataggacgttattttaagagacacggcgtccagtttctgagatcattaaacggcaccattgatgatgaattgatcaccaattctctggaatataagagagtcggaagatacgttggaacaatcgatattcctgatttgacatccaccgtttaaaagctgtaaatctgtcaatactctggatatgatgttagaaagggtgtggcagagtatatgaagctggaagaaaaagcaattctccgttttttggacagatttgatgagactccgtttcttgtcagaatcagagaagaagagtatacaatcggacatggaaatcccagattctctatcattttcaaaaaagaaccggatctgaaagagatgattacaagtacatcgctggcactgggagaggcctatatgcggggcgatttagagatcgacggggatctgtatcaggccctgtactattttctcggtcagatggggaacttttctgtggataccagagtattaaggaaactcatgtttccgtctctggggagaagaaagcagaaagaagacgtctcatcgcattatgatttgggaaacgacttttacagtctctggctggatgagactttaaactattcctgcggatattttgagaatgagcaggatacgctttttgatgcacagaaaaagaagacacagaggatactgaaaaagctttatctgaaggaaggtatggagcttttagacattggatgcggctggggatatcttctcatagaggccgcaaagaaatataaaatcaggggcacagggattacgctgagcagagaacaacagcagggatttgaaaaaaggatcagggaagaaggacttgaggattacctgcatgctgaactgatggattatcgtgatcttgctgggtacgggaaaaagtttgaccgggttgtcagcgtgggtatgctggaacatgtgggccgggatcattatgaattgtttttccagtgtatcaaaagggcgatgaagccgggaggggtatttctcctgcattttatcagtgcactggaagaacatccgggagatccatggatgaagaaatatattttcccgggaggtgtgataccgagtctgcgggagatcaccagtctgagcgccaagtatcgcttttatttactcgacgcagaaagcctgaggaggcattataataaaacgctgctgtgctgggataagaattttaatgagcacagaagagagatcgaagaacggttcggagagacatttgccaggatgtgggatttgtatctttgtgcctgtgcgtcaacctttcagaatggtattattgatctgcatcagcttttatttaccaatgggataaataatgaactgccgatgacaagatggtattgaaaaaataaaaatcaaagagggtatttcataagccacagcgcagctttgaaataccctctttttaatatccgattacatttatgatcttctggttaatccgtcccagttcatcgctgacctgataattttcagtgtcaaacaggtattgatgtacccggacagcattttctttcagagtggttgggaagccataccatactccgagatatttgtattccttctgatcaaacgggaatcctttctgacccttaatgtcataccggaagatcgataagagcatagagaacagttctttctggtccatattggttttgatctgtgggagaatcttatccatggcacccatcaggccaaatggatttttttgcctttggcaaagatcttctgaagaacttcacgctgccgtccggcacgggcaagatctcctcctgcggtatagcggattcttgaatatgcgacggcctggttcccatccagtgtatgcaatccgccggtttttattttgggggagtagcctccgtttaaacggttcatgtcaccgatatagctgttcagattttttaatatcgaggaatcgacttttacttctattccaccgatggcatctacgatgtccgcaagaattttgaagtttacggtcgcatactgggtgatattcaaatccaggtttcggttgatggtactgacagcgagttcgggacctcccatggaatacgccgcattgatcttagtgtagtggccgttgacactcacataagtatcacggtagatagacagcatcttgatttcttttgtctgattattgatgctgacaacgataatggaatcagaacggttgccccggtccgacatacttccagtctgagaatcaatgccgaacaaggcaatattggtgtaatctttcatattggcatcctcatggaccgtgaccagcttgctctgattcattggtgtggagttgatcttgcccagtttcgtgtaggaaaccccgaggatcacgccaatcagaacaacgatcaggaaaagtaagataaagatccagcggataggggaatgccgtcgtttgtctgcttttacgctcataaaaacctcctagtaagcgttcttgttaataaatcctttgaaaacggtcagaaacaggattttaaaatccaatgataaggtccagttttcaatataatagagatcatgctcaattctgccgcggatggatgtgtcaccgcggaaaccgttgacctgggcccagcctgtgatgcccggacggacctgatgcttgatcatatagcgggggatctcttccttaaacttttctacaaacagcggacgctccggccggggtcccacaagactcatatctccccgcagaacattataaaactggggaagctcgtccagactggtatgacggataaactttccgaacggggtcacccgcgggtcgtttggccttgtccactgagttgcttcttttttcgggtcctgaacccccatggaacggaacttgtacatcttaaatggtttgttgccaagcccgactctttcctgtgcaaagaagaccggtcccggtgaactgcgttttaccagcagtgcgataatcagcatcggaacagccaggatgatcagggcgcaggcagatccgatgatgtcgatggtcctcttggcaatacggtttacaacgtttgtcagaggcacattgcggatattgatgacgggaagaccgtccagatcctcggtgtatgggtttgtggaaataaagttataatagtcaggtacaaattttgtatgaacaccggatttttcacagatggccaccagtttttccagtttttcatattcatccagattcagcgtgattgcaacttcgtccagaggagtctggcttaaatagtcttccagttcatttaacaagccgatttttttgatccctctgtattcaaagttgtcgctgatggtatcatcaaaaataccgtggatatagaggccccagtggggattggctttgatgcggtcaatgtaggcggcggcagaggtactgaagccgacaaggactacatgttttaaatttcgtccgctttcccgtgtgctgttcagcacttttctgattgtgaagcgggaaagaactccaatgataaaattaacagagaaaaataaaagcaggaggcttcgggggaagttctgcagttttgtcaggacaatggcaacagacccgatgcccagaccggcaagatttgctttcaacaggtttacaatttcacggcttccgcgctgatatctttttggggtatacaggccgaaaaaagtatataataaaagaaggataatgattgtaataataaccgtcttctgatagtatgaaaatcccaattcgtactttccgacaaagaaaaataacttagagatccacgaatcctttccccattcgaagcggatcttatgtgacagaaaagccgataaataaatacagaccgcatcaataaaaatatgcaggcggtttaaataggcttggttttgcttaatcatttgttttctcctctttacgataatattacactgtacttattataagtgaaaaagggcaaaggcacaatggaattatttcttatgtttttcttagttttataacatttaaaacacattttttacacatttattttgtactatttaagcaggttaaatacgaaaggagatacaggttatgtacgaagatatgaattataataatacagaatatacacagccggatcaaaatcaaaataaaggaaacaaaaatagaacaggcaggaagatcgcaaagctggcggctgccgcagtggctttcggtctgatcgcaggagtcaccattcagggagtccagtatgggttttctgcaatgggcataggcaacggagggacacagctggcaacgaccaatacaacaaaaacttcggcaaagggaacggcatcaggaaaagaagatttatctacagtggcatctaacgtcatgccgtccatcgtttctatcacaagcaagtatgtgaccagttccggaaactttttcgggcagcagcaggacaatgagagcgagggagcaggttccggcattatcgtcggtaagaaagacgggtacctgctggttgtcacaaataaccacgtcatcgccgatgcacagtcgatatccgtcggattcacagacggtaccagcgcatccggtacgatcaagggaacagacaatgacgcggacctggcagttgtcgcggtaaaggtaaaggatattaaggctgccacattaaaaaagatcaagatcataacactcggaaattctgatgacctgaaagtgggagagcaggcgatcgccataggaaatgcactcggatacggacagtcagtcaccggcgggtatatcagcgcgctgaacagagaagtgcagctgacggataaaaccatgacgcttcttcagacagatgctgcgattaatccagggaacagcggaggagctcttctcaacagcaaaggggagctgatcggaatcaatacggtaaaatattcttccgaagacgtagagggaatgggatatgcaattccgattaatacggcgaaaccaatcatcgatcagctgatcaagcagaaaactgtagataaatccgagcaggcttaccttggaatatcaggtcagaccatatcaagcgatatggcagcgcagatggatatgccgcagggagcgctggtgcgtcaggttgtccggaattcaccggcgcagaaggcgggtatcagtgccggcgatgtaatcatcagctttgacggggccacggtttctacgatggagggcctgaagagcaagattgaaagcaaaaaagccggagatacagtaaaagttgctgtaaagcggcagaatcaaatggggacttacgagaagaaaacattcagtgtcaaactggaaaaaaagacggatgacggagcttcaggcagtacgcagaataactaaacggaaacggttgaattctcaaagcatacaagttacaatgaagacgggcggcaggcagccgtccgtttttaacgtaacagaaaagaggattcatatgatttcaattgagatagaacacataaaatcttttatggccggctttctgacgggggacgtgtgtgaccagtttatgctgtacgaaggcaggctgtccatggggaccatgtatgaatttgacggaaaaatgctgaaagatttttatgatacagatgaatgggaaatactgaaagagtatccgtatataccgtggaaaatggagaagcagagaatattttcccttataaaggggaaaaagactcccctgtcttttcagtttgtgcttatgctgaatccgaaacgaatggaagcctttcttttgaaatataatatatctgacaggccgcagcagatcggaggattatttttaaatatttatttcgacagaaaacacttgaagtgtacgacaggagtgtcaagaaacacatttgttccggataaaaccctggagacagcctgggatgaagagatgacattatttttgaaaggcagataggaggagcaggcctatgaagttattaaaagagatttgccggggaatactgatcggggttgccaatatcattcccggggtcagcggagggactctggcggtttccatgggagtttacgacaagatcatctatgcactcacacatatacgcaaagagtttaaacagagccttaaaatactggttccagtgggcattggagcggtgattggactgatagggctttcctttgtcattaaatggctgtttgagtattatccgattcagacaaactttctgtttatcggtctgattatcggaggactgcctgccatatttaagagaatggaaggagagagaaagggcctttcccatgggattgcatttcttttgatgtttgctctggttgtactcctgcctcttttaggcagcagcacggcatcggaagtgatcttgactgccgatcccctgatgatggggaaaatgtttttgatcgggattattgcggcggctacaatggtcgtaccgggagtcagcggctcgatgatacttttgattctgggattttatcagccgattctccgtgaaatcacacagtttatggtcaatctggcgactttgaatctgtccggactcactcacggtattctgcttctgactccgatggctgttgggatcatagcgggagtggtgatcatcgccaagatcatagaatatttgtttgaacattttgaggctattacgtttgcgggaatcggcggactgattcttggttccccgattgcaattctttatgaggcaaattttgatcattttaatctgttctcaggagtgacgggactggctgcactggccgtgggctgcgtctgcgcctattatctgggtgaagattaaagggttttcatttatagaaatatatgatatgatatgtagtaatgaatactatatcggaaagttttaaaaggagacgccatatgagttttaatattgtctgtgacagctgcacggatttgacgaaagaagattttgagaagggatgctatacctggatacctctgacactgctgatcggagatgaagagatcgtcgatgacgatacgtttgaccagcattctttcctggaaaaagtggcaaacagcaaaggagcctgcaagtcagcctgtccggcgccggaagcttatatggaagcatataaaaaggcagatgatatttatgtggtgactttatccgcggagctgagcggatcctataacagtgccgaacttggaaaaaaactgtatgaggaggagctgggagaaaagaatattcatgtatttaattccagaggagcgtccagtacgcagcttctcatagcaagaaagatttatgaatatgcttcccagggcatgtcctttgagcaggtggtagagaaggtagaggattacatcagagggcagagaactttttttgttctggagacattggatgtgcttcagagaaatggaaggctgtcaaaggtgaatgcagttcttgcgacggctcttaatataaagccggttatggaagggaccaaagaagggatcatacagaagctggcacaggccaggggtacaaagaaggcattggccaaaatggcggaatgcattgtaaaagaaggacaggatctgacggaacggattttggccattgcacactgcaactgctatgaaagagcagtgtatcttaagaaactgctcgaagacaaactggaagtgaaagagatcatcatagttgataccaagggagtcagcagcctgtatgcatgtgacggcggtgtagttgttgcatattagttcatagtggaatacaaaaggaaacggttttggaccgtttccttttttgcggattgatacagagaaaggcttattgttctaaagtgtaaaatcctttgaaatcagcgactggatttcattgatgagaagactggtgtgatatccatcggctgcggcatgagaaattgtgactgtaaacggcattagacagcggccgtttttgatctggtattttccataagtgataatcggaaagagatttgggctgccctctgcagtcgtggtgctgtatccggtaaaagacagccagggcacacaggaaatacagaagaaattagggggctgtccgggcctggctttgattcctttgttatttccgtataaagacaaatcctctgtcatctgccggtaaaaagaggaaaagtcttcagtgtaatttgtccacgagtctgaaaaggtgtgatcatcatcgtgaaaaacagtgtaggagggatgaacgatatcccaatatccgggctgtccgtcttcggaaatacccatccggaattctttcatatgattgatcacggttgagacacagtagacaaaactgggataaaatctgagacctttgttcttggtcagttttaaaaattcggttacatctaattctgcagtcaggctgtaaccacattttattgtttgggtaaaatattcaaaatgttctcgccgctcccaagtctcggggctgatttgtttaaacatgaggcacctccattttctaacttttgtattttattataaaggaaaagaaggaatgtgtaaaaacagattgttaaaaaaatatacaagttttttgctggcgtatgaaatattttgcacgaaaatatgagggttcagcagtatgcagaatccaaatactatgaataagatgtgtaaaaagcccggatttatgcgatttttcgttatttaattaacggtgtttttagacgaaaactattgtatgacaaatagaaattgtatataattagatacaatatttataaagaaagggtgatggaatgagtcgattagaaattgtaacaccgggccgtgcacagattgtgatggagggtctgtataaagatttggagagaaggatagagtccagtccgccggggatctgcccggtcgatatgtcgagggcatttcttgagttatgtcatgcgcagacatgcggtaaatgtgtgccctgcaggattggtcttgggcagcttaaaaacctgatcaatgatgtcctggatggaaaggcaactatagagacattgggactgatcagggatacggcgcagtcaatcatggattcagcagactgtgcgatcggctatgaggctgccaatatggtatataaaggagtgatcggtttcagagatgattatcttgaacatatcatgtacaaccgttgcctgatgtcgttaaaacttccggtgccctgtgtgtctttatgtccggcgagagtcgatattccgggttatattgccctggtcagggaagaaaggtatgcggatgccgtccgcctgatacgcaaagacaatcccctgccgacaacctgcggttttatatgcgagcatccgtgcgaagctaagtgccgcagaaatatgatcgatgattcggtaaatattcgtggattaaaacgggtagccgcagattttgccggcaaagttcctcctccgccatgcggtgaagagactggaaaaaaggtagccattgtgggcggcggaccgggagggctgagtgctgcctattatcttagactgatgggacacgatgttacaatttatgagatgctgccgaagctgggcggcatgttaagatacggcattccaaattaccggcttccaaaggaacggctggatgaagatatcgaggctatcctcgccaccggcgtcaaggtgcagtatggcactgtcattggaaagaattgttctgtaagtgaattgagggaacagcacgatgctgtcctgatatccatcggcgccagcaccgataaaaagcttggactcgaaggagaagacgcagaaggtgtcatttccgcagtccagtttttaagagatgtaggccatggacggtgtgagtgcctggagggacgggaagtggcagtgatcggcggaggcaatgtctccatggatgcggtgcggacagcagtccgtctcggcgcaaaaaaagtaagtattgtctaccggcggcgagttgccgatatgacggctctggaggaagagattcagggagccgtggcagaaggggttgaggtgaagaccctgatggctccgtcgaagatcgaggtttcagaagacggaaatgtaaaagggatctgggtaacgccccagatgatcagcaggatacaaaacggcagagccagtgtgaagcccaccggtgaggaagatgtctttatcccatgcgagacacttgtagtggcgatcggacaggatattttgtatgagcattttgaggagaacggagtacctgttcagagaggcaagatcaagactgaaaaatacggagggtttgacgatattccgggagtgtttgcagggggagactgtgcaacggggccagccacggttatttctgccatcgctgctggaaaagtcattgctgcaaatattgatgaatatctcggctttcatcatgaaatcacctgtgatgtggagattccggagccgcgtcttaacgaccgtcctccgtgcggccgggtgaatatgacagagagagaggccggagaacgtgtacaagattttgaaggagtagaaaactgtatgtcaaaagctgaggcttatcaggagtccgggcggtgcctgcgctgtgaccactttggattcggagtatttaaaggagggagggatacgaaatggtaacactgacgattgaccaaatgaaagtaacggtgcctgagggcacgacaattatggaggcggcagcttccattcatatcgatatcccaaagctctgttatttaaaaggcattaatgaaatcagtgcctgccgcgtctgcgttgtggagatggaaggcaaagacaaactgatcacatcctgcaataatgtagtggaagagggcatggtcatctatacaaacagtcccaaggtgcggttaaaccggagaaaaacggtttcgatgcttttgtcacagcatgacgggcagtgcatcacctgcagcaggagcatgaactgcagcctccagaagatcgcaaatgattttaacatactggagaacccatttaaaaaagaatttgtacataaagaatgggataagacatttcctttgatcagggatgcgaacaagtgtatcaaatgtatgcgctgcgttcagatctgtgataaggtacaggggctgaatgtatgggatgtatccggcaccggggcaaggacaacggtggatgtatccaggaaccgggatatccgggtcgcggactgttctctctgcggacagtgcatcacacactgcccggtcggggcgctgagggagagggacgacacttctatgctgttcagcgccctggaagatgaaaacaagatcgtggttgctcagatcgcaccggcagtcagggctgcctgggcggagcagcttggcctttccagagaggaagcaccggttgagaagattgtgacggcatttcggagaatgggaatagactatgtattcgatacgacattttctgccgatcttacgatcatggaagagggaagcgagtttgtcaaacgtctgcaggatggggatttagaagagtatcctatgtttacttcatgctgtcccggctgggtaagatttataaagactcagttcccggacatgattggaaggctttccacagccaagtctccgcagcagatgttcggagcggtcatgaagacttattttgcaaagaaacttggagtagatccggaacgaatctttacactgtccattatgccgtgtctggctaagaaagcggaaagggagatggatttattttatgaagaatatgcaggccatgatattgactgcgtactgaccacaagagaactggaccgaatgctccgcgcagaacatttaaatcctcagtttttggagaaaggagaatttgattctccgtttgaaacaggcacaggtgcaggcgttatttttggggcaaccggcggtgttatggaagcggctttgaggtcggcttattttcttgtgaccggggagaatccggatgcggatgcttttcgtgagatccgtggagtcaaacgccagggatggacagaagccgagtttgatgtggcaggaaatgtcatccgtgtcgccgtagtaagcggtcttggcaacacaaggaatctgatggaagccatacgcagaaaagaagtgaagtatgagttcgtcgaggttatggcctgtccgggaggctgcgccggaggcggaggccagccgatccatgacgggcaggaactggcagaagagagaggatcaagcctctacttcctggaccgggatacagagatccgtttttcacatgacaatccggacatacaaaacctctatgaagagttctttgagaaaccactgtctcacagggcacaccagctgctacatacggaacaccaggtctgaatctatcaatctctttgacatggttttcttttttcgctataatagtaacaatttatggagaatgcaagaaaaggagaactagtatgagcaagatagagatgacgacaccattggttgagatggatggggacgaaatgacaagaattctttggaaaatgatcaaagacgaccttttgtccccttttatcaacctgaagacggaatattatgaccttggtctggagcacagaaatgccacggatgatcaggtgacctttgatgcggcagaagcaaccaaaaaatatggtgttgctgtcaaatgtgctacgattactccgaatgccgcaagaatggacgagtatgacttaaaagagatgtggaaaagcccgaacggtacgatccgtgctattttggacggaacagttttcagaactccgatcaccgtcaaaggaattgaaccgacagtccgcacatggaaaaagccgattaccattgcaagacatgcttacggtgatgtctacaaaggcgtcgagatcaaagtgcctggagcgggaaaagcagaattggtatacacggcagaagacggaacccagataaaagagctcattcatgattttgacggagcaggaatccttcagggcatgcataacacagagggttccatccggagttttgcgaagagctgttttacatacgcattggatacaaaacaggatctctggtttgccacaaaggataccatttcaaagaaatatgatcataccttcaaggatattttccaggagatttatgatgcagaatataaagaaaagtttgagacagcaggcatcgagtatttttatacattaatcgatgatgcggttgcccgtgtcatgaagtcagagggaggctatatctgggcctgtaaaaattatgacggggatgtaatgagtgatatggtatcttctgcattcggatctctcgccatgatgacttctgttttagtatcgccggatggatattatgagtatgaagcggcgcacggaacagtacagcgtcattactacaagcacctgaaaggggaagagacatccaccaactctgttgcaaccatttttgcatggacaggagctttgagaaagcgcggcgaattagattccaatgaagagctggttaaattcgcagacaggcttgagagggcgacgattgatacgatagaagagggtacgatgacaaaagatcttgcattgattactacgcttaagaacgtcaaagttgcaaacagcggggagtttattaaagcaatcgctgagaaattataacaaacaattataaaatattaccttctgtttaaccgatacttattcagcaggtcttcctctaatgcgaggagatatttacgataaagaaggggatcctgatagccacatggccaggatctttttttattacttaggaaagaccttgtcacgctaatgcgtgaaaggctttcctaagtaataaaaaaagatccgcgggttgtacacagatgcgtaaggaaatcatttgactacgtcaaatcgcatctggtacgcaaagtgttcatactaaaatggaaaaaattgttgatttcatattggcaacatggtataatcaatagcataattactctaaaatatacttactaagtgactgcaaaagataaattttgaataacgaaagggggagtttatggtgttatcgaatgaagattttcagcagcttgcgggattgtttgatataaagctgagtccgatcacccggcagctgggggccatagaaggcagactcgaaacagtggagagccggttggatacagtggagaacagattggatacggtagagacacatctgggaggaatagatgaaaggcttaacacggtagagacacatctgggagaaatagatgaaaggcttaacacggtagagacgcatctggtagaaatagatgaaagacttaatacggtagagacgcatctggtagaaatagatgaaagacttaacacggtagaaacgcatctggtagaaatagatgaaaggtttaacacggtagaaacgcatctggtagaaatggatgaaagattcaatgcagtagaagagcatttgggcgaacaggatgaaagatttaacacaatagagaagcatttaggcgaagtagatgagaagtttcatattgttgacaggcggatggatacgatgcagaatcagattactttgcttatacgaaagacagacaagatagaaaaagacctgtctggaactaaaggtatggtatcaaaaattgggaatacactggataatgaagtattgccaaaactgggagctttacacgacggatatttgcaaaacaaagatatttcattccgcttggtcacaaatatggagacagaatctttggaggatatcgatactttgaaaaaaatagcagaagatcattctgaacgaattaacaaattagaaagaaaatgctctgtttaagatgagaatgtaacaaaagtaaatttatggttgaaaaataaagagaaatgtattataatgtaaattaaggatgagaaatcattttcaccatctcttgtacgaatatatcattcatctcttctcaattataaactactactaaattacgcggcatcagatgtacgaatctcatttcaactgaatctaaatagaattctgatacttccaatccttgaagtgagaatgatttccatccttatactgatgcacatgaagaaaaaaacacttgacattatttggcaccctggaatataataataaaaaattgagaaatcctttgagcaaaagtaagtagcttggcaaacggttttacagagagctgccggttggtggaagacagcagatacgagtcatgcgaatgggtttgtgaggagcgcagagaacgcatattgtcagtaactgtcgacgtgatcccacgttacgggaacggagtataaaagcttaggcggagtactcttagaggagagtctgtaatttcagaaggactcttaaatttgggtggcaccacggtctatcgtcccttgtatgagggatgacaggccttttttgttatttagaaaagataggaggattctatgttaagtccaacattagaacaggtgaaaaatttattgacgatttatccgacagtaccggtgttttatgaggtgctggccgatcatgtgacaccgattcaggtttttatggcacttcgaaaggccggtaccccgtcctttatgctggaaagtgtggaaaacagagatcagtggggaaggtattcatttatcggtgtgaatccaaaaaaggaagtaaagataaacggcacagaaatagagattgacggaacaaaacagacagtggaaaaccatattgcatatttaatcgaaatggtcaatgcataccaatctccggtacttgttgataaaccaaagcttaccggaggatttatcggatatttcggttatgataccattcggtttgtggaaaagaaactggtcaatgtgcccgaggatgatctgaacatgccggaatgccatttgtgcatgtatgatgagattgtcgcatttgatcacctgacaaaccgggtgatcgtgatccagaatgttcatgaggaggatgatctggagacaaagtataagggtttggaaccaagagcaagaaaattgatcgaacagatcgacaatttccggatgtccagaaaagaacgtacagataaaaaagagacaaaggtaatttcaaatataacagaagaagagtacaaatccaaggtagaaaaagcaaaagaatacataagaaacggcgatatctttcaggttgtgctctcacagcggtttgaggtggaaagcgaggcagatccgtttgatgtttaccggtgtttaagaacaacaaatccatcgccgtacctgtacttttttgacttcgtagattatcagattgcaggtgcctctccggagatgctcgtaagtgtcaccaatggaatcgtgacgacgaaaccgattgcgggtactgtgccgagaggaacaacgaaaaaagaggatgatattctggtccggcagctcatgcatgatcccaaagaacaggcggagcacacgatgcttgtggatctagggcggaacgatgtgggaaaagtcagccggttcggaacggtacgtgtggataactttatgtcagtagaaaaatattcgaaggtgacccatttagtcagcgacgtacagggcgagctgagagaagacaaaactgcactggatgcccttatgagcatacttcctgccggcacattgtccggtgccccaaaagtcagagccatggagatcattgacgagttagaagataaaaagcgagggctatacggcgggaccgtgggatatctggcatttgacgggaacattgatacgtgtatcgcgatccgtacggtgctttttaaagatgggaaaggatatgtccaggcaggagctggaattgtggctgattcagaaccggaaaaagaatacgaagagactaaaaacaaagcgctggcagtcatcaatgcgattaaggaggcggcagaattatgattttattaatagacaattacgattcctttacttataacgtctgtcaggggatcggcgagctgtatgagaatattgtagtcgtcagaaatgatgagattacagtggaagaactggcacaaagagagatcgaagcgctgattatctctccgggacccggatatccggaatctgcgggtatttcaaaggaggcagtccggtattttgcaggaaaagttccggtgcttgggatctgtctgggacaccaggccatcggtgaggtattcggggctaagacggttcgtgccaaaactctgatgcacggaaaacagagtaagattcagattgacagcagtcttcctctgtttcagggactgccggaaataatcccggcagccagataccattctctgattcttgagagggaggggataccggaagtgctcacggttgcggccaaagacgatgagggacagatcatggctgtaaaacacagagactatgacgtgtacgggatacaatttcatccggaatctattttgacggaatccggaaaagcaatttttgaaaatttcttaaagatagcaggtatagagacaaagacagaaaagaaggtggaagagatggaaccggcacagaaaactgcgatgaaaccatatttagaaaaaattgtcgagggaagacatctgacagctgatgaggcatacggagctatggactgcattatgtcaggaggcgcgacccaggcgcagatcgcaagttttgtcacagggctgcgcatgaaccatgagactgtggatgaaattaccggatttgcaaaagtcatgcgcgcgaaagcagccgttgttcccaatgagacagaggccattgatattgtaggaaccggcggtgacttggccagcagttttaatatctccacaacatccgcatttgtgattgcaggggcgggacagaaggttgcaaaacatggaaaccgaagtgtctcatctaaaagcggggcggccgatgtgctggaagccctgggtgccaagatcggactttctccggagcagaatcagaaatgcctggaggaggtgggagtcgcctttctgtttgcacagacacaccatggctctatgaaatatgccggacctgtgagggcccagcttggagtgagatctgtatttaacattttagggcctctggcaaatccggccatgacaaattatattgtactgggtgtatacgaggaagatcttctgagacctatggcggaagtcatgcagaatctgggtgtgaagcaggcaatgatcgtgtacggggatgactgcctggatgagatctccatatccgatacgaccagtatctgtgagatacgggacgggaagctgatttcttataagatcagcccggaagaattcggaatccctatggcagaaaaggactccatcaaaggaggaacatcggatgaaaatgcggtgatcacaagagaaattctgacgggaaaagaacaggggccgaaaagggacatcgtacttctcaatgcgggaagcgccctctataccataggggcagcaaaagatatgaaggaaggaatcgagatggcaaggcggtccattgactccggcagtgccatagaaaaactcaaccaattcattgaatttaccaatcgctattaggagaacaccaatgattttagacgatattgtagagaagagaaaagaacagcttgagagggaaaaagaaaatttccctctggaagatatgaaggagatggctttacattccaagagagtctccctggattttaaagctgcactgaaggctgatggaatttcgattatatccgaagtaaagaaagcgtccccatccaaaggaatcatctcagaagatttccgtccaacagagcaggcgaaagcctatgaagaagccggtgcagacgctatttcctgtctgacagaggaacatttttttaaaggagcaagtaagtatctggcggatatcagagccagcgtaaacctgccgatcctgagaaaagactttatatttgacgaataccagatttatgaggcaaaagtgctgggagccgatgcagtcctgctgatcgctgcgatcctttcggaagtaaaacttttgaagctttcctggctggcggcatctctgggactgttttgtctgacagaagtccacaatgaggaggaacttcaaaaagtcatccgctgcaaatgtgatatcatcggcatcaataaccgggatctgaaaacatttcatgtggacttgaatactacgaaacgattggcaaaactggtaccgtatgatgcagtgctcgtctctgagagcggcatgaaaaacggagacgatataaaggaagtgaaagagtacggagccgatgcggtgctgatcggagagactttgatgcgttcaggagatattaaaaatacaatcaatgaactgagaggaagcctatgaaaattaaaatgtgcgggcttcgcagaccggacgatataatttacgcaaatgagtgccttccggactatataggattcgtttttgctgagagcagaagaaaagtcagcggcagagaggcaaaaaaattgggggaacagctggacccgtccattaagaaagtcggcgtttttgtaaatgaaccgctccggtccctgatttccatatcagaagaggcgggactcgacatcattcagctgcacggagatgaaggagaagagtacatcaaagaagtgaaacatgaaaccggaaaagaactatggaaagctgtccgggtgagaatggtaaaagatattcaggaggcacagagactcccggcggataagctcttgctggacagtttctcagaagagtcttatggaggcacggggaaagtcatggattttgcggtgcttgaccaggcagatatccggaaaccgtattttatagcgggaggtcttacggttgagaatctgccggagatcttaaaaaaggcagagccgtatgggattgatatctccagcgggattgagactgaaggggtaaaagacagggaaaagatgctcaaggtaatacagtgtgtaagaggaggaaaagatgagtaaaatcggaagattcggagatttcggaggacagtatgtgcctgagatcgtgatgaacgcggtcaatgaactgaatgaggcatatgaaacatataaaaatgatccagactttttggaagagctgcatgaatattataaaaactatgcaaacaggccgtctatgctttacgaggcaaagcgtatgaccaaagatctgggaggtgcaaaggtattcctgaaaagggaagatttaaatcacaccggagcccataagatcaacaatgtgctggggcagatattgcttgcgaagaggatgggcaaaaagcgcatcattgccgaaaccggagcagggcagcacggagtggccacagccacagtggcggcgctgtttgatatggaatgtgtcgtctacatgggagcggaggacgtggaacgccagagtctcaatgcttatcggatggaactgctgggagcaaaagttgtggccgtgcagagcggtacgcgaaccttaaaagacgcgatcaacgaagctatgagagactgggctacgaatattgagacaactttttactgcatcggttctgttatggggcctcatccttatccgaccatggtcagggattttcagaagatcatcggggaagagacgaaacgccagatgcaggaaaaggaaggaaaacttccggactgtgtgatcgcctgcgtgggcggcgggagcaatgccatgggagctttctatgactttgtaaaagataagaatgtgcgccttgtcggagccgaggcggcgggaagaggggttcatacaatccagcatgcggccacgatcgccaggggaagcaagggtatttttcacggaatgaagagcctttttcttcaaaatgaggaaggacagattgatgaggtttattctatttccgcaggtcttgactatccgggaatcggaccggaacacgcccaccttcatgacattggcagggcagaatatgtgagcgtcacggatgaacaggcagtatgcgcatttgagtacttaacaaagatggaagggattattccggccattgaatcagcccatgcggtagccgcggcaatggaaattgtcccgaatatgaaaaaggatgaaagtgttgtgatctgtctgtccggccggggagacaaggatgtgtttcaggcagcaagatatagaggagtgaagttagatgagaattaaagaagcatttgagaagagaaagaaaaatggacagaaagcgctgattacctatatcgtgtccggtgattttggatatgagactactaagaaaaatatcatgagtatggtaaatgccggtgcggatatcgtagagatcggaattccgttttctgatcccatagcagaagggatcgttatccaggaagccagccagcattcgctggaaggcggaactacgctggccggaatttttaagatggtgaaggaactgagaaatgaaacggatacaccgtttgtgatgatgatgtacttaaatacgatttaccgttttgggacggaacgtttttttgacctctgtaatgaatgcgggattgacggtgtcatcgtgccggatatgccgtttgaggagaaggatgagatacagggaacagctacggctcatggtgttgacaacatcagcctggtaacgcctgcttctcacgaccgaatcgaatccattgcgaaggacgcagagggatttttgtactgtgtctcatctattggtgtaacagggacgagaaatgagttttccacagactttgacgcattttttgatgtgattaagaaaaacgcagatattccctgtgcggtgggatttggaatttcaggtccggaacaggccaaaaagatgagtcagtattgtgacggcgtgatcgtgggcagcgctattgtaaagatcatcagcgagtatggagaagacagtccaaaaaaggtatatgagtttacaaaaagccttcgggatgcgctggatgaataaaattttgtgcaaaatgtacaaattatatggatgagtaaatgtcagatattaataaaatttaaaaatatttttctgaaaacttattaaaatttaaaaaatgtggtaaaataagtatataatacaaaatgctgagaccggaattaactccggtcttcttttattccataggaaagtttgtccacgttgttatttttcagagaaaggagttacactgcagtgcagatagaggaacggatacaagaacttataaaggctgccgggcagaaccataatgtcattcagctggatgaggtcgatcaggtctttgataagagtttgagtgagcaggaatttgattatgttatcggccgtctgaaagaccaaaatatagaattttcggattttacagcggcaggccatgcagacacggcggaagctgaaaatgctgtgatggaggattcagtgaaggcttatctgcacaggataggcaggattccgctgctttccaaagaccaggaagaaagactggcaaaggaaattgaagcgggaagccagtcggcaaaagataaaatgatcaattccaacctgcgtctggtcgtcagtgttgcaaaaaggtatgctgcaggcagcggcatggcgcttctggatctgatccaggaaggcaatatagggcttatgaaagcggtggacaagtttgattaccggagaggatacaagttcagtacctatgccatgtggtggatccggcagtctgtcacaagggctatcgcggaccaggccaggacgatccggatacccgtccacatgaaagaaaagatggggaaagtcagcggtgcggccagaaaatttttagaagaaaacggacgggaacccaatgcagatgaactggcagaattgatggaaatcagcagggatcagatggatgagatcatgagattgtacagtgacactgtatctctagactctccggtcggagaagaggaagatgcgatgctcatgaattttgtagcggacgagagcatgccggaacaatatcagacggcggagcagggaattctctctgaacagataaatgagatattgtcagaactcaccgaacgtgaacagacgattttaaggctgcgttttggatttgtagaaaataggatctggacactggaggaagtagggagagaatatcatgtgacgagagagcgcatacgccagatcgaaggaaaagctttgagaaagctgaaaatgaaaaaggaaacgaaatctctaagagcctatattgaagactgattttggtacttttttaaaaaatcagccggcgggaggaaaattcccccggttgatttttttttcattctcctttatactttgcatcgaaacatgaagctgaaaaggaaaagggtaaaagatgagagagaaaaggtatgaggaactggttccatatgtagaacaggcgaaacagggcagcgaagatgcgtttgcctatctgtacgaagcgaccatagagccgacccgttattttgtctataatttctgtaaaaatagaaataaggtggaagatcttcttcaggaaatctatctggaagtgtaccggtctctgccgtctttaaaagataatatggcgttctgtgcctggcagcgccagattacatatcattgctgcgtaaaatctataaaagagaatgaagaagcttttatcggggatgacaacattgaatttataaaaagtctgacggacagcagtgaaactcctcaggatatagttttgcagaatgagaagtcagaactgctgaacaggtgtatccagaagctgccggaaaagcagagagctgctctgttactttactcttttcagcagatgcggatgaaagaaatcggaaaggtcctggactgcaaagagaatgcagtaaaaaatcttttgtttaacgccagaaagaatttgaaaaaacagatcgagatgcttcctcaggaggaacgggatgtgctgaacatcagaagcttcggtatttttactctctatccgttcctgcgggagtctcttacttatgcatctaaaaaaggagtgaagcagggcactctcatgatcaagaaggctgtgatgggagctgccgtggccgcgggagtcggaatcacgggagttcttgtattcgggagcacggatcttccggagcaggacttccatgaaattcagctgaaaagtccggactgggagactcacgatctgtccggactacggataccgaaaaagaaagtgaaaaaaacagtgccagtgtcggttccggtaaatgtgaccagaatcagggcggataagaagaaggaaaggcttgagatttatgtgaccggagatgtaaacttcgaaagcacgtttgcaaaagacaagaaaggaaagattttcagaccggaaagttacagcagtcagaaaaaggttctgtatttttctgtttttgtgaatgattttgaactccatttaaaatcaaaggacggaacaacagaaatttttgacttccggcagaaataactgagatcaagaaggattgccatgctggtgctccttctttttttgttccacaggaaaactgttctgtggaataaaaaatattggtttttggtctaactcttttttacggtaccaatacctgataagaaaaaatgtcagattacgaggaaaaggagcagcagttatgaaaagaaaaattttagtcttcttgttggtcattgtatttgggacgggacaggctatggtttttgcggagtccggggtacaggaagcagcagaagtggaggcagaacaggcagaagatagaaagcctgaagcggacataggaaatacagaggatacagaatcgacaacagaagaatcggagaccgaaaccagtacccaagcgggagatttgtcaaaagacatggaagaaattgggggggcttaagcagatttaagaatacagaaaatattacagaaacattcctggatgctgatgagacgatcgtccctctggtgaataaagtttctgaaaagtctctgaaaaagacgaaagaaggacagaccatgctggatgtgagtcttgggaatatcaggatcaatcagactggtgcatcaggcggaggactttcagaggcagagacagagctgaatccgaatggttattatattacagggaaaacgaattcgtacaatgtagttgtagcaaaaggggtcaagacggcactgacactagacagcgtagagattgcaagcaacggatcgacccagagctgtgtgattgtttcacatgcagatgtgacgatcacactgagaggtatcaataaattggattgtaattatgggacgactgggtcggtaggaggagctgcacttgccaaggaaggaatggacggatttttaaccgtacaatgtgaatacgcagataaagaaggacatcagtgtgatgacagctgcggcacattgattgcaaagggaaatgtgcctcacgcaggagctattggcagtacaatatctaatgctggaaaagcaggggaaggaggattttgtaattttcggatcaaagggggaaatcttgaagtcagcggaggtactcatgtagcgggaatcggttctgcatgtaatacacaatcttactttggaggagtcgcgtatacaaaaaatatttatatctcaggaggaaatatcaaaacaacagggactgagtgtggacctggtataggtggaggattcggagctgacttcgatggcctttatataactggaggtaaaattgaggcacggggaggcaaaaatgcacctggaatagggacaagtgtgggagatgcagatacttataagctaaaaaatgtgcatatcagcggcggagacacggttgtcatcgcgataggagataaaagtacaaatatgcccgggatcggagcggccggagggaatgattatgtcagcaatgtaacggcagagcctgacccaggttatcagggatatattcaggatggcacgagccttgaggattacagctttatggagggaacgccatttcatgggaagaccaatatccgggtaggaagattctacacgaaggtttactttggaccgttccgggatgtgaacggaatcgaggatgatacgaaagagcagatcggagccaaccatgtgatcagcaagagcggcgggaaaccgtttacggaggaattgcttcatcatcttacaaaggtaacggggaaacaggaaaacgggacaaactttctgccggaacagctgacgctggcaaaaccggaggaactggaagttatcaatgccgcgaagacaaagggagaaatcggggattttcctctgacctatacgactcccaacggcacggaagtaacggtgacagtgttcttaagaaatgacggtgaggatgcagggggatttgataaagagaacataaaagaacagatcggagccaatgactttacaaaggaaacggggggcagcccgtttacagaagaggatatcaagcatctgggtgaggtaaaaggtaaagataaggaaggcaacaatatttctctcgacgatttctctgtggatcaggaacagttcaaaaagatcaatgaacataagacacaggggaaagccggggagtttgagctgacctattctgatgcaaagggaaataaagtaaccgtcacggtcacactggtcggtgagtacgatgcgattacagaaaacccggacacaggtgagatgataaaggggaaacatatcatcagcaaaaccggcggcgacggttttacgaaaaagcagctgaaagagctgtccatggttaaagcggtggacaaagacgggacggagattccgacagaggatcttagttttgcggaggaagagcagattgcagcgatcaatgaagcaaagaccgcagggaagaccggcgattttcctctgactttccggacgccggacaatacaacggttacaatcactgtatttctgagagatgagggaacagatgccgcaaaggaaggacaggatgatcctttttctgtgatcggagcgaaccatacgacacagcctacaaagggagagccctttacggaggaacagatcatcgaactctgccaggcaaaaggaaaagacaagaacctggataatgcaaagattctggtggatgaaagacagctggcagtgatcaacaaagcaaaaaaagatggaaaaacgggagtttttgacctcaccttttccctttctgacggaaataaagccacagtaaaggtgacgctgacaggagatcacagagtatcctttgatcctgacggaggagactaccagccggaaacacagacagtcaaaggaggcgactgtgcggaagctccgagggaccctgcaaaagagggatatgtatttgaaggctggtattatatagatgaagacggaaatgaagtgaagtgggatttcaagactccggttcacagtgatgtaaagttaaaggcgaagtggaaagaagcggacaggacggagactacggcggcacctacaactgcgaaaaagccaaaaaagaaaaagacggtgccggaatgggaatataagaaaagagtaagaaggaagcgcgtcagcagaacaggagatgggagacagatcctgtgtctcatccttgtgttcggggcgtcattgaccggacttgcggcagggtttaggaaaaagaaaaaataaagaaggcagagcaataaaagctcctgagtccctcaataaggaggacccaggagctttttgtgagttttagcagatcaggttaaaaaacattatttaaattttggacggtcaaatgtcagtgtattgcctgtcgcataagcgcttctgaactggctgtacataagttttccgatcttctgggcatatcccggatctgtggcatactggtgccagatgtatttggtatttggattgtagcggaatttgtacagggtattttgtttgtaggtactgttattaatatattcctggctgacatattttgcagcgcctttgatggctttgtccacacttgtccagccctgatagtatgcgtagctgaatccgcaaagctgtgggtcagaatcataggccttgatgccgtataaattgtatacctttttagatgaaatcttctttgtctgatatttgccgtttactttttgaaaccctgtgacattgccttttttgtctttcacaacagactttcctgtgataaccttggtaatcgatttgccctgtgagagagtgcttgtaccataaccggtctccaaaatcgtctggcagaggaaataaacaggatcgatcttataagttttagcagcgctattgagaacagaacctttgtttttcagcacacttttggattttaccttactgtttaagagactgttatactttgagctgttgacggtgcggtatgtattcaaacgcaaatactggtagccgtgagtcggatcagtgctggttggaacataattgttgtaattgatcttctttttgtcgtaggtttttaccgtctgtgccttgatataatcggatgtcttcttattataattagtcgctgtgttttttgtatataagtagctgtttcccggcttgttgatgtggattctctttgctgaagagatataggaatagtccagtcctaaattcttgatcgtaaaattagccggaagcagaatattatattttttggtcgtgtagtacttgactgagacgggtgcagcggataatgttttcttcttgccgttcacatagcaggttttcttattcttatagaaagtcagcgttttgttcttgtacttgagtacaagtttgcctgtttttttgctgtaactgcgcttgattttgggcccgttctttacgagaatactgtaataagggatcatgttaatactcttcatctgaatgcctggtgtttttgtggaaatcccttttttagcgtatgtaaagtttagctgttttcccgtatagtatcttgtcttgcctccgtatctgatctttaaggacgcagccgagatatccgattttgggaaaacggataaaatcgatgtaaaggcaaataatatcgtaaatactgcaatgattcgtttcttcataacttatttatcctcctattgtaattaaaatgtaatataagtatagcattatattaaaaaatatacaataaattcgtaatataaatgtaatatttaaaacggaacagaggaagaaagattggttttgggaaataaaaaatagcccaggatttgtacctgagctatttattgactgctctgttctctagttgaatactggtgtgtcataaataaatccgctggtgctggaataaacactttgatatgtattcatcagcttgccgatggactgggcgtaggccgggtcagaggcatactgatgccagagattatttagattttggttataacgaattttatagagtgtattttgtttatatgtattgttgtgaacataccatttagataaaaatttaccggcgccctgaatggctttatccacactcgtccagccctgattataagcgtaagtgaatccacacaactgtggagcagcatcgaccgcttttatgccatagaggttatagactgtttttttctgctccgctgcggataaagtttttacttccaaatatccgctttctgttttgacatatttccgtttactgtttctatctttagaggctatgtacttaaatgctgtgatctcaccggaagagtcttttatcagagattcaccggtaacaattttaccttttaaatcttgagactttaatttcgtatcttttaaattttgagatttgattcctttagccaaagtacttgtcccataaccgctttcatgtactgtctggcaaagaaaataaagtgggtcgagattataagtctttgcagtattcgtaatgactgaggcttttcctgacagaacacttccggactttttggaaaccatagtctggagtgtggaattaaacttagaagaattaaccgcatgataagtgtctacgcgaagaaattgaaaactgttcgtattatccgtagttacaggaatgtattttttatagtctatcgtctttccgccgtaagttttccattgggcctgctgtttttttatgtaattagtcagtgtcgtattatattttgtcgttgtattggacttcacagtagaatcgggtttgcttgccgccgctggctttgcataatcaatacgttttgcagagcttgagtatgtatagctgatgcccagatacttggctgtaaattttgccgggagcagaatatagtttttgttgatgctccgatactttacagtcagcggggcagtggtaaacgtccgtttcaccccgttggtataggcatattttttattcttataaaacgtaatcgttttcttgccgttggtcagtaccagctttccggtctttttattgtagcttctctttactttcggtccgttctttacgatggcattataatatggaagcatgttgaccttgttgatctggatgcccggggcctttcctaaattaatcttttttcctttataataaaacgtgagctgtttccccttgtatgtgcggtttttcccggaataccgcagtgacaggcttcctgcgaagacagaggcagtcatcgagatgctcagtaccgcagacatagcgagtattttcattcctttttttctcatggtagatattccccttcctttctttaccaaagataagtttactataacacggatgacaccgcaaaaacaaggattttccaggcagaacggcaggaaatactatccatggagattgacaaaaagcatgtagtttgatagtatattaacgtatgaatttagtacactaatgtgctatcatgacaggaaataaaaacggaggagttttaggatgagagtgaaaaaattattagtgctttgcgtaagtgctgtgctggcaggttctatgcttttggcaggatgttcaaagaaagaagaaagtaagacagacgagtcacttcagtatgtaaaagacaacaaagaattaatactgggattggatgcctctttccctcctatgggattcacagacaaggatcagaagatcgtaggctttgacattgacatggcaaaagaagtcaccaagagaatggggatcaaattaaaattacagccgatcaactgggattccaaagaccaggaactgcagggaaagaccatcgactgtatctggaacggactgacatacagcgaagacagggcaaaagagatgctttgttctgagtcttacatggataaccaccaggtgctgctcgtaccggaaaagagcaagatcaagagcttaaaagatattaaaaagcagcaggtgggagtacagaaaggttctacggccgcagatgctgttgaccagacaaaagaattaaaaaatgcaaagattgtatacttcggcaacaatgttgagatcttaaatgaccttggaaatggctgtgatgcagctgtcatggatgaagtggttgcaaaatattacgcgaagaaggacccgggaaaattcaagatcttaaatgacaatttaattactgagaaatatgttatcggtttccgtaccggagatgaaaaactgaaagcagaagtagaaaaacagttaaaggatatgaaaaaagacggaacactggctaagatcagtaaaaaatggtttggcgaagatctgacaacaatcaaataagagacaagaagcaagaggcttttttcaaagcctcttgattttttcaccaacacagaaattaatttctgacagaaaaattccggaaaatttatacttataggagcaaaaaaatgatagatggtatcatacaatggtttgaaaaactgcctggcattgcagatatgctgttacataacggattggatcagacgctgatcatctttttcctcacactggtcttcggcctgacactggggcttgtactggcgcttgggagaatgaccagatttaagatcattcagcttccggtgcgtttttacttgctgattatgagaggtacaccgttgatcctccagttatacggtttttatttcggtctgaatctgcttttaggcatacgaatcgaacggactatggcagcggttgtggcattttctttaaactatgccgcttattttgcggagatctaccggagcggaattcaggcgataccgaacggacagtacgaggctgcaaaagtgcttggattcggtaaggcacagacattctttaagatcattctgccgcaggtagtcaagatcattctgccgccgatgggaagtgagtgcatgactcttgtaaaagatacttccctggcacatgtcatcggtgtcatggaaatttatgtggtcgcagccaataatatgtccagaagccgcgggatggaatatttgatcgtggcaggtattttttatctgatcatgaatatgattgtatctaaagtttttggcatcctggaaaaacggatgagttattatcgttaaggaggaaagaaaatgagtgttttatctgtgactaatctccagaaaaatttcggaaagctgaaggtcttaaaagatatttctttccaaattaacgacggagagatcgtgacgatcattggttcctccggttccggaaaatccacgctgttaagatgcatgaatcagctggaaaaggtgaccaagggaaccatcgagatcaacggacatacgctggtatccatgaacggagacacaccggagtatgcgtcaaaagaggtacaaaagaaaatactgatggagacaggatttgtttttcagaatttcaatctgtttccacactacagtgtgctgagaaatgtcatggaggccccggtacaggtggccggtatcccgaaagaagaggccagggagaaggcattcggactgctcagaaagctcggactcgaagaaaaggccgatgcttatccgtgtgaactgtcaggcggacagtcccaaagagtctccatagcaagggcgctggctctggagccgaagattctgttcttcgatgagccgacttctgcactggacccggagctgaccggagaggtgctgaaagtcattaaatccctggcagacctgaatatgactatggtgattgtcacccatgagatggcatttgcgaaggagatctcagaccgggtcatcttcatggaccagggggtcatcgtggaagacgcggctccggaggatgtgtttaactcggccaatgagcggacgagggaattcctcggaaagtaccacgatattgcctgacagtgcggtaaacagggcttttaattgttaagaatcatagtaagaaaggagcaatcaagatgataaaaaatatgccgaataagttttctgaaattacacccgaaattgaagaactggcaaaaaagtgtgagaagaaaatcgatcccactctttttgaaaagtatgacgtgaaaagaggactgcggaaacagagcggagagggtgtactggcaggactgactgatatttcgacgatcatgtcctatatggtcgaggacagagagattgttccatgtgatggaaaattatactatcacggaattgacattgaagatattgtccagggatttatcaaagaagagcggtatggattcgaggaaacagtttatcttctcttattcggggaactgcccaatgaggaacagcttcaggatttaaaacagctcctggcggaataccgtcagcttccgacaaattttgtccgggacattatcatgaaggctccgagccgggatatgatgaatacgctggcgagaagtgtgcttacgttattttcttacgatgataacgccagtgatacttctataccgaatgtgctcaggcagtcacttcagctgattgcacttttccctgtgctggcggtttacggatatcaggcatacagccactacgaaaaaggagaaagcctggtgatccatccgcctcaagagaatctgtccacggcggaaaatattctgtacctgttaaggccggacagcaagtatacaaaactggaggcaaaaatcctggatcttgctctggttctccatgcggagcacggcggcggaaacaactcgactttcacgactcacgtggtttcctcttcgggaacagatacatattcttctgtggcagcggcactgtgttctttaaagggaccgaaacatgggggagcaaacatcaaggttgttcagatgtttgctgatatcaaagaacatgtaaaggactggacggatgagaaggaactgaaagaatacctgaccaggatcgtgaggaaagaggcctttgatcagtccggactgatctatggaatggggcatgcggtttattctatttccgatccgcggtcaaaggtattaagttactttgtagagggactctcaaaagaaaagggaaaagaaaaggaatatgctttatataccaatgtagaaaagctggcaaaacaagtcatcgccgaagagcgaagaatctataaaggcgtcagcgcaaatatcgacttttacagcggttttatttacagtatgctggatcttccttacgagctgtatactccgctgtttgctatcgcgagaattgcgggatggagcgcacacaggatggaggagcttgtaaacggcggaaggatcataagaccggcgtacaaaggcgtggccgggcataaaacctatacaccgataaaagaacgttaataaggaaaaaatatgggcctgccggagagatccggaaggcccgttttagttactgtgctgttgttgcggcaggtgctgtggtggaagcagcaggagcttccttataagtatcaaggtcatcaggaagtgttactttcacatcttttccgatgttgtggtacttaaagtccaggatcatcttgactttaagtttcgtatcttctttgcttgaaacaaccatgttgatcttctgtgcggtgatctctgagtctttattgacggtcatggtaccggacatagattcaaattttacctggtccgcataattggtgccggcacctgcgactcctgtggaattcatctgtcccatgatcttattgacatagtcattcagggctttttcttttaatttaaaggagatgacatagttgtctcctttcttatccatcttcagacctttgtagtttttggcgtttgtgttgaactgtccggcagtgttttccatctgtttctgcatggcagcaaaatccatcttttgtttctgcttctgaccggaatagtttatataatagtaaccgtcggtgtaataagccttaaagttcagatcctgtccggctatgcccatggtcatgtccatatccattttcatgtcctcggatgtcatatcggtagctttcatcttgagtcccatgttcatctcaaggctggaactggtggatgatgtactgctcattttcatcttgatgtttccgctcatatcggcagatgttactttgctcatcttcttcgtggcagcttccaatacttcctcgggagttttcttcttacatcctcccagtgtaaaaagcatcacggcagccaaagtaagtgccagaactctttttaatctcttcataactgtcctcctgtgttcttaataaaattagaatacattacaagataattatagctgtttttctttccaaggtaaagcaaaacgagtataatacatcataacagacaggataaaaataatcggaggatggagtatgaagagagaattgtatataaaatcagaagtagaccgtcatcgtctccatgttttaatactggcaccagaaaatcagcccagggcagtggttcagatctgccatgggatgagtgagcacaaggaacgctatcttccttttatggaatatttgcaaaaccggggctatgccgcagtgatccatgaccacagaggacatggtaagagcatagaaagagaagacgatcttggatatttttacgacacctccggacgggccgttgtggaggatgcccatcaggttacggagtggatcaaaatggagttccccggcctgcctgtccatttatttgggcacagtatggggtctttgattgtgcggtgctatttgaaaaagtatgactgggagctgagttcgctgaccgtatgcggaagtcccagtaaaaatcctctggcaaaaccagccgcagggatggcaaagattgcatgcagaatctgcggagaccggaagaaaggcttgttttttcacaaactggcattcggagccttcaataagcagctcagggacggagaatcattaaacggctggatcagttacgataaagataacgtcaggaagtacgatgaagaaccgctggacgggtttgtctttacaaacaacggatttttaaatctgtttcatctgatggatgagacatacagccggagaggatgggagaagaaaaagacagatctgccgattctgtttatcgcaggagaagatgatccgtgtatcatatcccaaaaacaattctggaatgctgtctcttttttaaaggagcttgggtatgcagacacaaaagggaaactatatcccggatgcagacacgaaatcttgaacgaatcatgttccggccagatatataaggaaatactcggatttatcgaataaatgaaacagaggatacataatcatgaaaacaaagaggatactgcttacagcactctgtatgatgctggtatgggcaggaggagagagacaaattcagggagcatcgaagaaacccgggaagccttccggagtgatggccaccggcgtaaaaaggaatattgttctgtcctgggtaaagggaaaaagagccacagggacggagatttatctgtacgacaaagcgaagaaaaagtatagaaaaaaagctgtctcaaagtcatccagacatgtgatcaaaggcttgaagcccggggtcaattactgttttaaagtccgttctttcaggaaatacaaaaagaaaaaatattacagcagattttctaaaacagtgaaagtatcgatggcagccagaggagaatctactattaaaaattttctgaaaacagccgcagccccggtgggcaccaccttatacatctggggcggaggatggaataaagccgataccggaaccgggaaagacgggaagcggatcggactgaacggggagtggaaccgatttttcctgtcgcagaattcggggtataattataaaaagtaccgctaccgcagaggaaaaggcctggactgctccggcttcgtcgggtggaccgtgtataatatcagaaatacggtaccgggcagaggcggttatgtgcggaaagcaaaagaccagcctgaattgtttgcccaaaaaggctggggaacatataaaagcaagagtaaggtgacagactacaaagcaggagacattatgggatcttcaagctgcggccacgtatggatcgtcatcggctcctgtaaagacggcagtgtcgttttggttcattccagtccgaaaggagtgcagatttccggaacggccacaccgggaggaaagaaaaaaagccaggcactggcacttgcaagaaaatatatgaaaaagtatcatagaaaatggtacacaagatatccggactgttccaggggaaggagttatcttacccaatacggacagatgagatgggatatttcgggaaatcatattatggaagacccggaaggctatcagaagaaaagtgccggggcgatcctgaaagatctatatgaaaactagaacacaaggaggataaaaatgaaaaacacgatagagagaatacctttgcctttggcagggccgatgctcggctttgccgccatgggaattatgatagaaaattattctgtaactttaaagtcagtctgcggagccatggccgtctgtctgctgatccttttgctgttaaagaccggaacttgtctcgacatggtaaaagaagaactggaagatccggtaaactgcagtatttcgggtgcgttttccatgggtctgcttgtcctgaccgtttatatcaaaccttatgtgggggatgccgtttctatcttgtggattcttgcactggcggtgcatgtgtatcttttggtatatttcaacggacactttatatattacaagtttaacattaaaaatgtgtatgcaagcttttttatcttctatgccggactggcgatgagcagcatgacggctcccaacgctgatatgagagagattggccgctggtttttctgggcagcccttctctttacggtgatcattgctgttccgattataaagagatatgcaaaagtcaaggaaataccggaagagtatcagccgctggtctgtatctttgcggcacccgcaagccttctgctggcagggtacctaaactgctttgaaaagccaatggcatggctggtaatcgtactaacggttttatctgtaatcttatatgtttttgtgcttgcggcgggattaaaatatattgtcatgccgtttacaccatcgtttgccgcttatacatttccatttgtgatcagtgccgcagcattaaaagaagcttttatcacactgagccagtggggatatccggtaacctatttaaaatggatcgtagatttccagaccgtgctttcggcagctctgctgatctatgtgacactgcagtttctgaaatatatattttatgtcaaacaataaactcatacttgcagaagagaatccagcaaagcattattttcctcttcttttcggaagcagaatctgatatattccccgtcaagcccttcaaaacttgaacagtcacggatcatcagccctttcttgatacagcgttcaaacatctcatgagaagtggtgccgtccgtcagccggacaagaaggaaattggcataggctggataaatcttaaaagcaggggtgcctgaaagtctgtccgtacattttctgcgctcttctgcgatgtaagccttcgtctttttaatatagtctgtatccatgaacattgcttctcctgcaagcgctgcaagagtattgatgctccatggattttttttgtcttccactgccctgataaaattcgcatttccgctgatcccgtagccgaggcggatgcccggtgcagcaaagaactttgaagttccccgcaggacaaacagattgtcaaactttcgggtcaggggtacggcagtgacatcgtctatatccggggcaaactctgcgtaagtctcgtctgccaaaacaaagatgccgtgctttttacagtgggaaaggatctccgagatttggtccttgtttaatgcactggatgtgggattgtttggattgcagaatgcgaataaatccacatcatcggtgagggagtgtttcaagtcttcgatgtccaggcaaaagtccgaggattccttcaggttatactccagacaggtgccgccgatcatagaaatttcccgcatgtattcagagtaagtcggggaaagcagcagagctttcttcggacggagaaggtgcatggtcaggctgatcagctctgtcactccgtttccgacaatgatatgctccataggaatccgggcatacaggctcagtgtggagcgcagggacttgtagtcgcggtcgggatacgtgcagacagcatctacatggcggatcaggctttcccgaaacagcggggagatcccgaggggatttacgttgcctccgaaaggaatgatgtcttcttttttaatcccatatatttcttctattttttctaagtcgcttccgtggaagacttgcttcttttctgacatagtttcacctttctttatcttttctattttgtcgaagtttgctataatattacggagcagagatcaaagggtgtgaagcatccatgacctctgaaatacaaaactttattacagctattatagaccaaataccctgagaccaccagtcttaaaatcggaggaacccatgacagagaagatgaagcagttcatacaaattgtacaggaagatgaacagcgggcaaaggccctctttttttctgaggccttcaaaaatgagtatttggaggagaattccagggaaaaggaaatctatcatcagctcctgctcggccgaaaccggggccagatctttgaagagtttttgatctgtatcggggcaaaagaacctgcggtgctgagaccggaaaaggatgcgtatgagatccgtcgggtgaatgcggttgagcctctgtacgtgaagatttacaaagagggcagcggttttgtccaggggaagatccgcctggattccacgtttctgtctctgcaaaagacagaattttcagaagaggattttgtggaaggggtactgaccattcccgtgctgttttctgatgctagggaagagagccggggaattcttacggtttctgccccgtacagcagctgtcagacagacatcctgttcaatgcagagaaagagagaaacgaaggggcctggaatctgtccgaccagattttcgatgcgtatatggaattttgtcttggcagatgtcatgtcacggagtttgcggaaaaggaaatgaatctgaccgcacagatggagggagaggcatccttagagatactgaggactctcttaaacctgcactgtcatattgttctcggcgcagaggaagcaatcgagagaggctttgcaagacttgagccgaatatgagtgaggttcagtcagatcctttttactatggctattatttatatttgaaagcactttatttaaagacaccggatcagacagagtatgcaaaagaccggatttatgagctttttcagaaagcggacgatcacaagggatatctgctgtggatgctgatttatcttgacgaagagctggcatatgatttcggacttcagcttcagaagataaaagaggtttatgatacaggccggtgcagcagctttttatggtttgaggccgtcagcatttggaaccaggatcacagcagggcaaaaaagatcactgattttgagagagagatcattcatttcggcatttgcagggacctgtttgggaaaagcatgaaaaaacatatttacggtcttgtgctgaaagacaaaggattttcggaggagctgctttttgatttgatactgtcctttcagagagaggagtcaaaggaagggctccaggcgatctgctctatgctgatccggggaaactgtaccgatgagtgttatcatatatattttaaaaaagctgtccgggcggggattcagatgatcggactccaggaatcttaccttcgtacgattccaaaagaccgatatccgtatcttgagaagaatgtactgctgtatttttcgtacagcaacagtttaagcagccgggagagggcttacctgtatgccaatcttgttaagaaccggcgaaaatatgaggcagtatttccatcttttgagccgcagattgaagaatttctcttggaacagctggcagaaggcagaatcaattctaatctgtttattctttacagggccttctttgaccgccttttggaagggatgaaaggcagggccggaatcgcagggattatggcaaagcagaaattgatctgcaggaatccggcggtggaaaaggccgccgtctatcatcaggagttaaaagaagttcagaatgtttctctggaaaacggggaagtttatgtgacggtctacagcgaccctctggtcgtgtttatggatcaggaggacaaccgctatctgtcactggactatgaattttcaaaactgtggacgagggagcaggaggaggctgtattttcggggcttggcaggagaaatgaagcatatttgatccgcagaagcctggtctttgcacagaagacagaatatgaacccggagatgttccggatgtgagggctgtccttgaatgtcagagcctgaaagaagaatatcggcacagattatttgaaaagcttctggactattactggaagcatggagagcaggaacaattagagcaggcgctgtctatggtccagtggaaatttctctccgaggaaaactgtaagcagatgctggagtatttcattgccggccgccactacaaagaggcgatgaaaggcatggagatctttggatttgatttcatggacccggagccgttaaaagaggtcgtgctgcatgaactcacatcccggagccggaagagggtgcagactttgatcgatatgtgccttgcggtttttaagggacaagtatacaacagcgagattcttgcatatctggaacgttttttcaggggagacctggatcagatgcggaagatctggaaacagggagacagacacaaaatatatgatcagcagtttacggagcagcttcttgatatggccgtcgggaaaggagcagagtgggaggaccttcctgtcttcttatcttatgttgagaaggattccagagacaaaaaactgataaaaaagctggcgggccagtttgcagaactgtcttatgaagaaggagtgtatatttcggatgagttttatccgattctcggaaggctgatcgatcaggggaatctcaaactgatctggcagtgggcttatctggatttttataaagataaagaattgtcagaagaagtcagagaaagaataaaaaaactcatagagtggcaggaggaccgccgctgtatcctgccggtgcttttagaatataaagaggagatacctcttccatatgagtgctatacttatacttatgtagtttacaggggagagaaagcaggcggcatggtatttcactatgcggaaaacaggtcggagccggccagagagattcctatgagagagctgctgccggggtattatgtggcggaagttctgatctttgccgatgagtcggcagattattatgtgacagcaccgggagaagagagacgcaggagaaaagatatcgtctttcttgaccattccggaaggaaccagaagggaagattttatcagctgaatcacatgctgaaggaaaaacaaagggagagcgtagccatggaaatggaaatctacgcgtatgaaaaagcaatgacggatctgatccgtccgatgacagaggatctatgatgaaaataggcatacagatagagcgggaaatgatatatcagtgttccgtaacggacggaaagatcgtggaagaagaaccgaaaaagctttccggggactgggcggattatgtgcgtgcagaatcggaaaagcatgcggatacgtccaatctgtttatgggcgttattttggaggacccggaggaggacctggcgtcaaaagccgcggagcttagaaaagagctggggttttcggaggaacagctcaggctgtttacgaaggaggaggcttttctgggacttgccggggaccgaaaggaacagcttgaacagggggctgtggggctgtttgactattccggccagagattgttttactatctggtgaaaaagcaggatgggcagctgctcgtagagagagaagactactctgcttttatgagaaacacccggctgccccatcagaaagacatggcatttgagaacgccgctgttcaggctatgtcccaggaggttacttctttagtttatttgtacggcagaggatttgacggtggatggctgaaaagcgcttcggcaaagctgtgtgcgggacggcgtgtgtttatgggagatcatgtgtacgcgacaggggccgtctgtctgctgggaagaaaaaatgcggctgaccttgactctgccgtgattcttaccgacacggttatgatgtatcagatcggtgccatggtatggaaccacggaaaagaagaatttctgccggtcataaagggtggaaagccatggtttgagagccggggaaatatgacggtactggttgagacagcggcatccattcctgtggagatcaaacccctgtttcccgggaaaggtgacagaatgaggtttccaatttccttaaaagggcttaaaaaacgtccgggacgctctacaaagctgaagattgaagccgagtgcaccggggagacaaagtgcagaatcaaaatcacggatctggggtttgggacattatatccttctacataccaggtattccagcaggtaatttcatgggagaggaggggacagccatgagaatggtattgtgtgagacagaggagagcaggcggacttacacgctgaattcctttggacagaccatttcttcctatgaagaattatgttatattatttcaggacagtatttatattttctgacagaaggaatcccggaagggatgagagagtggatcgaagaagaacttggtctggtcctgccggcagaagaggagacaaagaagcagctggagcatattatcggttaccggaattattttacggttcccgagcagagaatgcttgtccagcagatgcgcacggcctatctatattcctctgtgagaaagcacaaaatgctcggcgacttatatctgaaacattccagatatctgagcgcttatcacgcctatcaaaaatcgctttccggtctgatgcagctgaagacaaaggaacagcaggaagttttgtatcacacgggactctgcctgacccggatgttccgttttcaggaggcgaaggagttttttaaaaggagctgccgcctgaaagagaacaagaaatgccaggaagcatatttcatagtctcttatatgcagggagattaccagaagtttttggaagacggcagagcgctttcttttacagaagaacagctgagagagatccatgaaaatatctcagctatggaggaacggttttccggaagcgaggaatccacagcactgaaaaagattggctatcacagaaagaaacccgatgacctgatgaccagaaggcttacctggtcgatgctggaacggtggaaaaatgagtacagaagagagattgtctgaaattgaatatcagaaaaaacggatggaattaaaccggcgttttgtggaaatgtatgaagatgaggtgtcttatattctggagcagaaggaagatatcgagatcatggaaaagctttccggtgaagaagcaaagctgatcagtgaggaagccagaaaatacaaccgcatctttgccaggattttttatgattccgcaggcggacgagtctccgatgaggaatttctgcccctctgggagagggaagaggaaataagacagggtttgtcccgtatccaatccctggagggtgaaaaaaaacagatcgagaaggaaatttcagtccaggaagatgaagaacgtgatctgaaaagaaaagagagggaatttcatggaaagttcatcaacaggagggcctattttctgtcttcgctgatcatggccctgactgccgcgggactcggtgcggcagcagttttttattttgagctccggctgagcgtttctctctggccggcagcggcagcagtgtttggtgcggctgtgatccttctgattctcaggacaagaaagaagaaagcggcagagaaaaagaaaatgtatcatatggtaagaaaccacaaagagacttcgggacggaggctcaaatcggagtatgatacgattgtcaatgaccttgaattctgcagagagaaatatcaggtgctgtttggatatatttccgaagaacagtggaaattatttgagttttgtgctaaagttgcagcggaattaaattgcagtgaagaactttccgcccagaggaagacgtttgtctcggccatggagcagtgtggaatgcatgcacctcaggcctggtgttattacccaaaggcaatttatgatataccgaaaaggatcaaccggatggaatggctgtccggccgtcagaacatctgtgagcaggcaatggtgcagcatgagcgggcgatccgcaacaatcttttagaataaaatataaaaagtaggagatatgatatgagtaaagaattggaaaagacttataacccgtctgagattgaagaccggttatatcagaagtggcttgacaacaaatattttcatgcagaagtggatcacagcaaaaaaccgtttacgattgtgattccgcctcccaatattacgggtaaactccatatggggcatgcactggatgagacgctgcaggatatcctgatccgctttaaaaaaatgcagggatacaatacactgtggcagccgggaacagatcatgccagcattgcaacggaagtcaagatcatcgaggcgctgaaagaggaaggcattgaaaaggaagatctgggaagagagaagtttcttgagagagcctgggagtggaaggaagagtacggcggcacaatcgtcagccagttaaagaagctgggttctgcctgtgactgggacagagagcgttttacgatggatgagggctgttccaaagcagtggaagaggtctttatcaagttatatgaaaaaggctatatatacaaagggtccaggatcatcaactggtgtccggtctgccagacttcaatttctgacgcagaagttgagcatgtggaccaggcaggtcatttctggcatatcaagtatccggttgcgggaaccgatgattatttagagattgctactacccgtcccgagacaatgcttggagatacggcggtggctgtccatccggacgatgaaagatatacacatcttgtagggaaaatgctggagcttccgctttgcggcagacagatcccgatcgtggcggatgaatatgtagacaaagagtttggaaccggtgctgtgaagatcactcctgcccatgatccaaatgattttgaagtcggaagacggcatggcctcccagtgatcaatgtgatgaacgatgacgccacgatcaatgaaaacggcggcagatatgagggcatggagcgttatgaggcgagaaaagccatcgtaaaagatctggaagaacagggatatctggtaaaaataaaagaacacgagcacaacgtcggaacccatgaccgctgcaaagctaccatcgagccgatggttaaaccccagtggttcgtaaagatggatgagctcgcgaagcctgccatcgaggcggttaaaaacggggacattaaatttgtgccggaacgttatacaaagacctatctgcactggcttgagaatatccgtgactggtgtatctccagacagctctggtggggacacaggattcctgcatattactgtgacgagtgcggcgaaactgtggtggcaaaagaaaaaccggaagtatgcccaaaatgcggatgcacacactttactcaggatgaggataccctggatacctggttcagttctgcgctgtggccgttttccacgttaggctggccggaacagacggaggaactggattatttctacccgaccaacgtattggtaaccggatatgacattatctttttctgggttgtcagaatggtattttccggatatgagcatacagggaaagcgccgtttgatacggtactgatccacggactcgtgagagacgacaaaggaagaaagatgagcaaatccctgggcaacggaattgatcctctggaagtcatcagccagtatggggcagatgcgctgagatttactctggtcaccggaaatgcgccgggcaatgatatgcgtttttacatggagcgtgtggaagccagccggaattttgccaataaagtgtggaatgcatcccgcttcatgatgatgaactttgaacaggcggacttttctcatgtggaactttccgatctgacaagcgcagaccggtggattttatctaaattcaacactctggccaaagatgtgacggataatatggacaagtatgagctgggaattgccgtacagaagctcaatgactttatatgggaagaattctgtgactggtatatcgagatggtgaaaccgcgtctctataacgatgaagacaacacgaaagccgcagctttgtggacgctgaaaaaggtgctttccgaatcactgaagctgcttcatccattcatgccgtttatcacagaggagatctactgcaatctgacaggggaagaatccattatgctggcatcctggccggaatacagagaggaatacagctttgcccgggaagaagctgcagtggaactcatgaaagaagcggtgaggggaatccggaatatacgtgccgagatgaacgtatccccgaaaaagaaagcaaaagtatttgttgtctctgaaaatgaagatgtaagagacatctttgaacaggggaaggtcttctttggaaccctgggttacgcaagcgaagtagctgtgcgggcggacagagaagggattgcggaggatgccgtatccacgatggtcccggatgccgtgatctatatgccgtttgcggagcttgtggacattgaaaaagaaattgagagactgaaaaaagaacagaagaaattaggcggagagatcaagcggtgcgaaggcatgctcaataacgaacgtttcttaagcaaagcaccggaacaaaaagtagaagaagagaaagaaaagctttcaaaataccggcagatgcttgaaaaagtggaagaacgtctgggtcagcttgtaaaataacatgacggattttgaagaagcaagaaattatttgaatcatgtgacgggtttcgctaaaaaaacatccttatccaatgtacaatggattctggatgttttgggaaatccagaaaaagatctgttcatgatccatgtagcaggcaccaacggaaagggttcagtctgtgcatttctggactcgatccttacgggcgcaggaataaggaccgggcggttttcgtccccgcatttgatccgcatggaagaacggatacagatcggcggcagagagatttccgaaaaaagattttcagaggtctttgcaaaagtaaagaatgccgtctttcaggcagtgaaggagggggcagatcatccttccttctttgaatttctgttctttatgtcacttgtatttttccgggaagaacatgcggaggtctgtatcatcgagactggaatgggaggcaggcatgatgcgaccaatgtgatcatgccgaggctttctgtcatcactgcggtgagtcttgatcatcaggaatttttaggaaacactctgcagctgattgcggcagagaaagcagggatcataaaaccgggggttcctgtgatctgtctcaggcagaagcctgaggttctcagggtatttcaggaagaggccgcacataaagattcggaattcctaacaatttcaaaagataatcttattttttctgaaaaaagcagcgattatattgattttttgagaaagagtgcgtatgataaaaagagtgaatgcctgaaattaggcctgttgggcgattttcagtatgagaatgccgctcttgcggcagcagcagtccgcctgctgtttcctgacctgaaaagaaggacggtatttaacggtctttcctcagcttttctggcaggacggatggaggaagtgagtcccaatatttttatagacggaggacataatcttcaggcggcggaggcattctgccatacattagagaaatattttccgcagagaaaactgattgtttttgccccttcccataagaaggaagaggagggcatcctgaagcttctcacggaagttgaaaacttggaaggaatcataaaggttccggttgtgaaccgggagataccggagaatgatttcttaaaggcatataagacaatgataaaaaagtcagaggagggggttctctgcttttgtatcggctctttttatttagctggtaaggttaaaacgtttatcttgaatggaggaagaaaatgattaattacagagaagagttaaaaaaatttgaaccttgcttagatgtggaccaggcagaggatgctatttacagcgatgatttaaaagatgtagaagatctgatcaatgaaatcaaaaaagacatagaagaagagaaatagtaaggtggcagatatgaagagtaaggaaaagattaaaaacagttccaaatactactacaaccttgggctggagaaagccaatgccaacgatctgaccggggccgtaaagaacctgaaagctgcgttgttttatgacaagaacgacatgaacgccaggaatcttttgggcttagtctactatcagatgggtgacatcgtccctgccctgagccagtgggtcatcagcagtaatctgaaaaaggaagaaaatgcggccattgattatctgaaagatgtgcaggagaatcctgtccagcttgacacggtcaaccaggtcattaaaaagtataatcaggctctcgtatacgcaaaacaggggaatgaagacctggcaatgatccagctgaaaaatgtcgtttccatgatgccgaattttatcaatgcacagcttctgattgccctgctttccatcaaagatgagaattataaagacgcccagaaggctttaaaaaatgtgctggaggtggactgcaaaaacccaagggcattagaatatctgcaggagacggaagctcttttaaaacctgcggatatgaaagcagaagacagcggtttggagagtgcagaagggccgaagaaaaaggttttaagcagcgttgtaggaaaatacgaggagctgccgtccaaccgccaccgcatggtatatatggtgggaggtattgtgatcggcgtgcttgtttccctggtgctcttatatccgagcattaagaaggcatccagctacaagtattcatccaagattgaaaattataaggaacagcttcttgccaaagagactcagttaaagagcaacgaaaaagacatcaaagaggcaaaggctgccgaggaaaaggcgaagaaagaattaaaagaatttgtcggagacagcaagacagagggaatctatgattctctgctgacagccatgcagtattacggcgaccgccagtatacggagtctgccgatgccctgctgaacatcgacagggataagctggaatcaaagaagatgaaagagatttatgacgatctggaacagaaggtttacccatatgcggccaccggactttacaacaagggaatcagtgcatataatcagggcaactacaaggatgccatcagcactttgaaaaaagcaatcaaagtaaaagacacaaatgtggggtcttatttctaccttgccagatcttatgagaaaaatggtgacaaggacaaagccatcaaggcatacgaggatgtcatcaagaagttcccgggcaccaacagtgcaaggaactcacagaattacctgaatcaattacagaacaaacaagcaaaaaatctttaaaacagcacttgggctgacaaagaaaccgataagacacgaaagagaaatatatccggaagatatcaaaaccttccggtgtatttctctttcatttttttatcatttaaaggagtgaatcatctatggcaacagaatatcaggttgaaaacaggacactgtatgtaaggcttgacggagaactggatcatcacttggcagagcgtgtcaggcataaatgtgatgtgatcctgaagtcatatccgatcagggatattgaatttgattttaagaataccggttttatggacagctccggtgtgggaatgatccttgggcggtacaagcagctgaagcctctcggaggcacggtgagcgtggtaaatgtcaacgatgtggttaaacggatcgtacacatggcgggtctgcacaagatcatcaatgagcgatagggatagggaggataagagatgatacatttagaattcaacagcgaatcagaaaatgaagggatcgcaagagtgctggcagcaacctatatgatgaagttcgatccgacgatggaagagatggcagatgtgaaaacagcggtttccgaagcggttacgaactgtattgtccacggatacgaggacgatcagggaaagatcttcatggatatttcaaatgaaggcagtgtccttaaaatcgtcattgaggatttcggtgtcggtattccggatgtaaaacaggcaatggaacctatgtatacgacaaaacctgatgaggagcggaccgggatgggattttcctttatggaagcattcatggacaagatcgaagtcagctctgagtcaggaaaaggaaccagagtcatcatggaaaagaaagtcaccgggaaataggccttttatatggacgagacaagagaattattaaagcttacgaaagaaggagatcaggatgcgagagagaagatcgtgcttgacaacatggggctgatctggagtgtggtaaagcgttttacagggcggggacacgagcccgaagatctgtttcagattgggagcatcggacttttaaaggccgtggacaagtttgacctctcctatgatgtaaaattttctacttatgcggtgccgatgatcaccggggagattaaacggtttttaagggatgacgggatgatcaaggtcagccgttccctgaaggagatcgcctaccaggtccggcaggcaggagaggcttttgccatgaagtacaacagggaagcaacgatagacgaactctccagggagacaaagattgccagagatgagattgtcgtcgcactggaggcaaacaaagatgtggaatctatttatcagccaagctatcaaagcgacgacagccaggtgcttttggtagataaactgccaggcgaggaaaatgagtcagatactgtcatcaaccatgtgatgctggaagaactcatggatacactgtccggagatgagagagaattgatcactatgcggtacttccatgggaagacacagcaggaaatcgcaaaaaaactttcgatttcccaggtacaggtttcaaggatggaaaagaaaatattgctccgcatgagaaaacaaattcttggacatagttgaaaattgtggtagtataatctaagagggaaatttccctcttacgattacaattctgtaaagatcggtcagattacaggtcatcggatacatcatccatttacccgcactgaatattgcaaatcgaatcaaaacaagaaacatcttatgtatttaaacaaaggagaatattctatggtatatgaatctatgtctttgctcgaacttcgaaaggcggcaaaggaaaagaatctgaaaggtatcagcagtctgaaaaagcaggagctgatcgaatatttaaaaaataatgacaatgaacataaacagagtgagccggaacaggagacgaaagcagagcagacaaaagacgtcaggacagaccgtgtgcccagggatataaaaagcctggacagcggcaggaaagccaatggtatactggaagtcctgccggacggttatggatttatccgctgtgagaattatctccccggagagaatgatatctatgtatcaccgacccagatccggaggtttaacttaaagtccggagatatcttaaacggtgccatccgcgtaaaaagccagagtgaaaagttcggagccctgctgtttgtagagtccgtaaacggatatcgccccgaggcggcagccaggagaaagcattttgaagacctcacgccgatctttccgaaccagaggctcaggctggagaccgagcgggcgacgattccgatgcgcatggtggatctgctctctcctgtgggaaaagggcagaggggtatgatcgtatcaccgcccaaaacaggaaagacgacgctgttaaagcagatggctcagagcatcagccaaaattataaagacatcaagctgatcgtactgctcattgacgagagacccgaggaagtgacggattttaaagaatctgtggagggacagaacgtggaggtcatctattctacgtttgatgagcttcctgatcatcacaagagagtgtcggaaatggtgcttgagagagcaaagcgcctggtagaacataaagaggacgtagtgatcctcttggacagtatcacaagacttgccagggcgtacaacctcaccgtgcctccgagcggaaggacgctcacaggagggcttgatccggcagcactccacatgccaaaaagattttttggagctgccagaaatatgagggaaggcggaagtctcacgatccttgcgacagcgctggtagagacgggaagcaagatggacgatgtcatcttcgaggagtttaagggaaccggaaacatggagcttgtactgagccgccatctgtccgagcgcaggatcttccctgcggtggatatcgccaaatccggtacgagaagagatgatctgctgctttccaaagatgaacagtctgtggtcaccgcactgcacaaagaactgtccggaagccgttcagacgaatttttcgagcagacactgaatatgttcaaacgttctaaaaataataaggaatttattgagtttgcgaagaaatctctgctgagaaaataagagaaaaagtatttgcattgtagaagatgctgtgatataatgagaaagctgtttaagaataaacaaaaggaatgtttaagataaactaagatcaaagaggtgaagaaacatgcgcgaaggaatccatccagaataccatcaggcaaaagtagtctgcaactgcggtaacgaatttgtaacaggatctacaaaggaagatatccacgttgagatctgttctaagtgtcattctttttacactggacaacagaaagctactcaagctcgcggacgtattgacaagttcaatcgtaagtatggtactaagtagaaaacatgaaatgataggttgaggttgcgaaatctcagcctattttgttgtatagctatttaaaaggaaggacgggcactatatgaaagtaaggattggcggacaggcggtcatggaaggcgtcatgatgaaaaatgaggaccgctatgcagtttccgtgagaaaaccggacggggagatcgagacgaagaccgaacggtatacgagcatatccgatcgatatcctgttctgaagctcccggtcctgcggggagtcgtaaattttgcggagtctatggtggtcggcatgaaaacactcacttattcggctgacttcatagaagacggggaagaggagccgtcccggctggaacagtggctgaaccgtcatttctctgagaaatgggaaggggtcctcatgggcggaatcgtggtgttgtcatttgccattgccatcggactgttcatggtgctgccttatttcctctccaacatatttgaagggttcggcatgagccgtccggctgttctgctgctggagggtctgatccgagtgggtatttttttaggatatatcattctcatatccagaatgaacgacatcaaacgggtcttcatgtaccacggagccgagcacaaaacgatcaactgcctggaggcaggggaggatctcacgccggaaaatgtaatgaaatattccaggctgcacaagcggtgcggtacgagtttcctgttttttgtcatgatcataagcattatatttttcttttttatccgtgtggacacggtgtggctgaaagttgcattgagacttctgctggtcccggtgatcgcaggggtatcctatgagtttatccggctcgccggaaattcagacaatccggtcatcacggcgctcagcaagccggggctgtgtcttcagcttttaacgacgaaagagccggatgagagcatgatcgaagtggcaatccggtcagtggagggtgtttttgactggaaaacatatctggagaaagaaaggaagaaccgtgaataggaagatttgggtcacatacggggcggaaatgctccgggaagcggggatcgataacccggatggggaagcctggtatctgttttcccattgcttttctttaagccgggaagaatacttattttctatgactacgccggtggaagaaggggaagaattagagcagtacaaggctttgctggaccgacggatcagcgagaggattcctctccaatacctgatcgggactcaggattttatgggatatacatttcgggtgaccccggatgtgctcataccaaggcaggatacggaaagtgtcatcgaggcggttgtggaaggaaactatccccatgaaagcatcctggatgtctgtacaggctccgggtgtattgccatcagcctttgtcttatgctgaagccggacgtctgcatcggtacagatattgatgaaaaggccctgaaaattgcaaaagagaatggaagaaggctggctcctatggtaaaatttaaaaagagtgacctcttttccggggtggacggttgttttgacctgatcatttccaatcctccgtatattcctacaaaagactgtatggaactgatgccggaagtaaaagaccacgagcccatgcttgctcttgacggaagagaggacgggctgtatttttaccgaaagcttgcagggacggccccgaagcatttgaacgccggaggcaccctcgtatttgagatcggttatgaccagggagcggcggtaaaaacgatgatggaggaagcaggattttcctctgtggagataaagaaagacttggcgggacttgaccggatggtcatcggaacgctggcataaaggagaagaagatgtttgataagttagaaagtttagtagagagaatggataccgtactccagcagctcaacgatccggatgtggccggagaccagaaccggttcagggatttgatgaaggagcagagcgatctggcacctatcgtagaaaagtataaggagtatgtacaggaaaagcagaacattgaggaaagtctggaacttctcgaagaggaatccgatgaggagatgaaggaactcgccaaagaggaactttccgagtccaaagcgaatgtagagcggctggaagaggaattaaagattcttctgattccaaaagatccaaatgacgacaagaacatcatcgtggaaatacgcgccggagccggcggggacgaagctgccctgtttgcggcagacgtggcccgcatgtaccggagttatgcggaaggacgccgctggaaggtggagacactgagttttaatgaaagcgggatcggaggttttaaagagcttgttttcatgatctcaggccagggtgcctattccagatttaaatatgaaagcggagtgcaccgtgtgcagagaatcccggccaccgagtccggcggaaggattcatacgtccactattacggttgctattatgccggaagtggaggatgtggaagtggaagtagatttaaatgactgtaagtttgacgtattccgtgcatccggaaacggaggacagtgtgtcaatacgacagattcagctgtgcggctgactcatctgccgaccggaatcgttgtatcctgccaggatgaaaagtcacagcttaagaataaggacaaggcattgaaggtgctgcgctcccgtctgtatgagctggagcagcagaaagcccatgacgcagaggcagaaaagagaaagagccaggtgggaaccggggaccgttccgagaagatcagaacctacaattatcctcagggccgtgtgacagatcacaggatcaagctgaccctccacaaattagattctgtcatgaacggagatctggatgagctcatcgacagtttaaccgctgcggatcaggcagccaaattaagtaatatggaagaagagtagatatgaaagatggttttattaaagtagctgcggcgacaccgaaggtgaaagtcgcagatccggaatataacacaaaagagatcataaagattatccggcaggcaggagatgaagaagccagccttcttgttttttctgaactggccgtttccggctatacatgcggggacctgtttttgcaggaccctctgctggaggaatcccttaagggactcatggagatcaagaaggaaacaaaagggatggacatggtcgtcaccgtgggctgtcctctggttgtggagcataagctttataactgcggtgtgtttttatttgacggacgtattttaggggtggtgccgaagatccaccttccgaattacggagagttttatgaagccagacattttgcaaaaggaaaaagagaggtaaaggacattctgctggacggggagtatgttccgtttggagcaaacatcctgctggaatgcacaaatatcccggaactgaccattgccatggaaatctgtgaggacctgtgggttcctcttccgccgagtactcatcacgctttggccggggcaaccgttatctgtaatccgtctgccagcgtggagactaccacgaaggaggtttacaggagcgccctcgtgtccaatcagtctgcaagactgctttcgggttacgtgtatgccaatgcaggagagggagaatccacaacggatgtagtttacagcggacaccatctgatctgtgaaaacggaaccgtgctggcagaggcgaagcggtttgtaaacgatattatctatgcggacatggacgtgaagcgccttgtggcagagagaagaaaaatgacgacgtttttcgaggaagattctgaggaataccgtagtgtgccgtttattcttccggtaaaagtaaaccagattacaagaaagtttccaaagaatccgtttgtgccgtccagcagggaagagcgggagaaacggtgtgatgagatcttatcgattcagtctatgggactgaaaaaacgtctggaacatacgaactgtacgcatgcggtggtgggaatttccggaggactggactctacccttgcagttttagtaactgtgcgtgcttttgatatgctggatattccaagggaaaatatcatttgcgtcacgatgccgtgtttcggtacgacagaccggacataccagaatgcagtatccctgatccatgaattgggagccactttaaaagaagttaatatcgagaaagccgtcagacagcattttaaagatattgaacatgaggaagatgtccacgatgtgacctatgaaaattcccaggcccgggagaggactcagatcctcatggatatcgccaataagtataacggcatggtcatcgggaccggcgatatgtcagagcttgctcttggctgggctacctataacggagaccatatgtccatgtatgcggtgaactgttctgtgccgaagactctggtgcgctatctggtactgtattatacagagacggttgaaaataaagagttatccgatgtgctgatggatgtgctggacaccccggtaagcccggaactgcttcctccggtggacggtgtgatctcgcagaagacagaggacttggtggggccgtatgaactgcatgatttcttcctatattatatgttgagatttggttttccaaaggcaaagctttaccgaatggcaaaacttacttttgcaggggattacgacgatgaaaccatacaaaagtggctggataaattctactggcggttcttcagccagcagtttaagcgctcttgcctgccggacgggccgaaggtgggaagtgtagcagtgtctccaagaggggatttgagaatgccgagcgatgccagcgtgaatatctggcagaagtcatagataaggattggagctgtgcagagttttgcatggctcctttttttgttatcagataaaatcttgctatggaatggaaagatctccaggcaggttggaaaatcgcatttagtgcacaaagtgggtaagtctctcaaagaggaggatttttcccaatctctaaaagcagatgaatgccggaaagccgcatagaataagggagggaagctattttggaaaagataagagaaaaatttatggcggttgggaaaaaattgagaaaacgttgattttatgcggaaaggcgattataatgaaaacaaagaatggcggaaaaacgttggataaataaaaacaagtgttgtattgaaatctgccattgcgcagggaattataaactctattccgataaataaaaacaagtgttgtattgaaataccccataagattcacttgtcccataagattcgttttggataaataaaaacaagtgttgtattgaaataatgatacctgcctctgaaataaaaaaacgtttttgataaataaaaacaaaagttattttaggcatacagaaaacaaacagatttgtgctgttgttgtaatatgattcatttaatgaatgaaaagaattctgtggaaatatccatacacagagttcttatttttttgtctttatttctgtgcaatctttattaagttttattttcttttattcatacttgcaaaatgaaagttaatatgataatatacaagtacaaagtaaaagataataaaagaaaacaaaatggaggagtcagaaatgaagttaagtgcagatcaaatagcaggcatggtagaccacacaaatctcaaagcctttgccgatgaagcaatgttcgaaaaattatgcggcgaagccagagaatatggttttaagatggtagccatcaatcctgcacagacagagcggtgcaaacgccttttggaaggatgtccggttcacgtaggggcagccataggatttccgctgggacagacaacactggaatgtaaagtatttgagacaaaggatgccatcgaaaaaggcgcagacgagatcgactatgtcatcaacattgcggaattaaagaacaaaaactatgattacataaaaaaagagatggaagagatcgtggcagagtgccgaaaagccagagtaatcagcaaggtcatctttgaaaactgctatctgaccgatgaagaaaaggtgaaagtagctgaaatagcaaaagaagtaaaacctgattttattaagacatcaaccgggtttggaacaggcggggctacaccggaagatgtgaagcttatgaagaccacagttggtgatgaagtgaaagtcaaggctgccgggggaatcagggacttaaagaccgcacttcagatgattgaagcgggagcagagcgtctgggaacaagtgcaggagtggaaattgtggaagaattaaaaaaacaggactgaagaggtggacaaaatgaagaaagttaaagtgtgtttgatcggttccggaagagcagggatgattcatgcaagaaatatggcgggaagtgttccgggcggtgagatttatgccacctgtgacccggacatcagtgcagccaaagccgcggcagaggagcttggaattgagacttattaccaggactatacggaagcgctcagtgatgaacagattgatgcggtaatcattgcctgcccgaccaaatatcacagagaaatcgcggtggctgcggctaatgagggaaaacacattttctgtgaaaagcctatggcgatgaatgaagaagagtgtgatgagatgatcaaggccgcagtggacaacggcgtaaagctccagatcggatttatgaggcggtttgacgacagcttcagagaagccaaaaaaatgatcgaagagggagaaatcggagatgttgtcctggtgaaatctcacacgagaggaccgagcaagccccgtgagtggatgtatgacattgaaaagagcaacggccctctggcggaggtgtgcagtcatgacattgacacggtacggtggtttgcaggaagtgaattaaagagtgtctatgcattgggagggaatttccggaataaagaaatcgcagaccagtatccggacttttatgacaacgtgatcgtgaatgcggaatttgaaaacggagtgcacgcctgcattgagggagcgcagtatgtgcagtatggctacgatgccagagtcgagatccttggcacaaaaggggtgatctgtatcggggatatgcatgaaaagaagattacaagtgccaatgaaacccacgaactcaagagaccttcaatgcacagctggactcatctgttcaaggatgcgtaccttttggaagacagaagttttgtcgaagcgattttaaatgacagcgaagtggaatgcagcggccatgacggaaaaatggcagtgaaaattgtgaaggcggggaatgaatcaattgtacagaagaaaatagtgaagttataagaaggataggaggaaattatgggaaatgaagcgacaggattccgtgccaggatccagaagttcggaggagttttaagcggcatggtaatgccgaatatcggggcgtttatcacttggggactgattacggcaatgtttttaaagacaggctggtttccaaatgaaaagattgccgtactgatcgatccgatgttaaagtatctgcttcctactttgatcggttatacgggaggaaagaacttttacggcgaccgcggcggtgtcatcggtgcggcagctaccatgggagttatcgtaggatctgatattccgatgtttatgggagccatgattatgggacctttggcagctctctgtatgaaacaggtggaccgtttgtttgaaggcagggtaaaaccgggatttgaaatgatcgtcaacaatttttcctgcgggattcttggaatcttcttagtgctggcagcattttttgcgatcggaccgtttgtacaggtattaaaccatgtgatgtctgccggagttaatgtcatcatcgatcacggccttacaccttttgcgagtatttttattgagcctgcgaaggttctgtttcttaacaatgcgattaaccacggaattcttggacctctgggaatcacccaggcggcagaggcaggaaaatcaatcttatttatcctggagccgaatccgggtccaggagtgggcgttttgctggcctatacattctttggtacaggaacagcgaaaaagacggcgcctggtgtagcaatcatccatgcattcggtggaatccatgaaccttattttccatatatcctcatgaagcctcagatgatccttgcatctatctgcggtgcggtgtcaggaaactttattttccagatgtttaactgcggattggtggcaaccgcttcaccgggaagttacttttccgtgctggcagtggcgccgaaatctgactatcttccgatcattgccggaatgctcgtatccactgccgtatcatttggggtcggcgcattcatcctgaggctctgccgtgattctgatgaagaagcactccagaaggcagtggcaaagaaagactctatgaaggcagaaggcacaggcggcggaggccgtatcggagcgcaggaagtcattgatttcacagggaaagtcatcaaaaaagtatatgtggcatgtgacgccggaatgggttccagtgccatgggagcatctatactcaaagataaggcaaaacaggcaggcctcgatattgaggtgaaaaacgtggcaatccccaatcttccggcagatgtggatgtggttgttacccatgaatcactgacggagcgggctatgagagagcgcccggaggcggtacatatctccgtggataactttctttccagtccaaagtacgatgagatcgtaaaaaaactgacagaggcaaaaaatcctcttccggtactgaaaaaggaaaatatcaaagtcacagatcagccaaaaacaaaagaagatgcaattcatatgattgcgcagatgcttttaaaggacggatatgtcacagaaagctatgagaagggcatgcttttgagggaaaaagaaaatccgaccaatctgggcaatggaatcgctatcccgcacggtgttcttgaagccaagaaggaaattaaagcatcgggtatcgctgcattaatcgtaccggatggaatcgtctggaatgacgagacagtgaggctggtgatcgggatcgcaggagccgaccaggaacacctgtccattctttcaaatgtcgcacttactctgaatgaggaggaggcagtaagaaagattgtagacggcagagacgcagatgaactgtatcatattttgacaaaatagcagaagcaaagctgcgggggcggtagttcccgcggcttttccttttgaggcctctgtgctataatttatctaaacataaagtacacagagagcacggagggatcgcatgtttgcagaagaaagaaaagaaaagatcatggagcttttaaggcagaataagaggacaagcatcggggagctcaccgaaatgtttcaggtcagcgggacaacgatccgtacttatctcacagagcttgaaaaggctggaaaactcgtccggacacacggaggagccatgctgaatgaggatgtcctggacatggaggagtccatctccgcgagaaaagataaacggatggaagagaagcagaagattgcaaaggctgccagagcaatgatcgaagacggcgacatgatccttctggacagcgggacgacgacactggaacttgccaagctcttaaaggatgcaaataatcttacggtggtgaccaatgaccttcaaatcgctttggaacttcagagacatcaggggatttatcttatatttttaggcggtcatgtgagaaactattttgaatgtacggtgggcagtatgggacttaaatttttggaaaatctgtctgcagataaggcttttatgtctgccaatgccctgtccctggccaaaggtgccactactccaaatttggaacaggcagagatcaagaaaggaatgatggggatcgcagagcggaaatatctgatctgcgacagttcaaaaatcggaaagcgtaccatctgttcctatgcaaaagcggaggagtttcaccgtctgatcaccgatgcacagataccggaccatgcaaaggaggccctggaaaagcaaggaatagaagtggtttgttcctgacaggataaggaggaaagtccgcacaattttatataaaataaaaaatcccgcagacagtggtgcacaccgtctgtgggattcttgcaaaatctatttaattcaaaaagaaaaagattaagctaatttggatacgttctcagcctgttttccgcgaggtccttctgcgatttcaaagctaacctgctgtccttcttctaaagtcttgaatccatcaccagagattgctgagaagtgtacgaatacatcgtctccgccttcctgagaaataaatccgtaacctttttctgagttaaaccattttactgtaccagtgttcatttgggtacctccattaaaaataaaaaattaacattactttcattatcagtaaaataaaaagatcacggtccagaggatacatagcaatgtaacatctacccggacgtgatctatacattcactaataacagtaattatcataccacaatcattgtttttttacaaatacttttttaaactatcgatactttcttcgtagagttttacaagatcagttgacatcgacaaattgtccttggaagcgtcacaatttttgtgggagctctggatcagctggatcattcccatggtatatccctggatggacatttccgctaaatggcttgtggatttatctgcgatggccttcatcttagtcatccattccgcatattttttctggatttctccgatttcttccggctgctgcatatcctttgtcatagcctgtttgactcttgagaaaaagtcctggaactgctgttcctgctgttccaaacaacctttcagatcacagtctgtggtggcctgtgttagctccggcatggtatttaacaccatctgaagattttgatacatctcgtttaataaattctggttatccataatgaaactcctttcaaatacatctgttacaggtagcatttacataaaacagaattattatacaaaagcaaggatctgtgttaaaattatcagaaagtaaaaagaagggaagtgaattttatgggaaaccgtgagagttttgagaaaaatatgagacgcagagtggaggccatccgccatgtgagcgaccacagtattttcaatgaattgagaggaaagattgtggattacaattatgatgaaaaacgtgtcacgatggaatatgaggtcggggatttccatcgaaacgggtttaatattatgtttggaggatctttggttgggatgttcgacatcaccttcggcacgctgacaagcggactgggcgattatgatatcgcacctacggtccagctctccacttcctttctgaagggagtacccattggatctacagtgacagtaaaagccgaagctgtgtccactggaaaaacgatcatgaatttcatgggaaaagcgtatgtgggagacgagctggtgggcagtgctaccggaatatttaagactccgagaccatttaaaacatttcggtaatcagtaattcaagacattctccacatgatttccgttcggctcttagaatggctcactccaatcatgtagaaaatggacgtaatgtctgctggaagggtatttttgaataaaaggggctattcaatgcaagatttctttattcattagccttcttcagaagaaactatgtccattttcaccagttcggaggcattgcattcgaaggaaggttagtttttcttctttcagcaaaggttcggaggtggtgcgcgaagcgcagtgaggctgtttgagcgtcagcgagttccgaacgggccgccggagaaactttgatgaaagttagaaaatcttaccttccggagacagcaagccgcagaactggtgaaaatgtcatgataatttacagggattggttttccttgtgtaccttctgcaccgcatttacgatattttcatagcccgtacaccggcagaggtttcctgccatatgtttccggatcatatcccgagtcagggttttttcacctcgttccagaaggactgtggcggacataataaaacccggggtgcagaagccgcactgaatggcgccttcttcgataaatgcctcctggattcttgtgagttctccattcggtcccatgaggccttccagagtgcggatctgttttccctgggcccacacggccagataaatacaggaatcgatggtctctccatccacaatgaccgtacaggcaccgcattcacccacctcacagcccttttttacggaagtcaggccaaggcggtttctgagcatttctaaaagggattctctcacatctacatattcagccacttcatgaccgttgaccgtacaggttataagttttttctgctgttccatactacctcacctcctggagttttacggctttttgcagtgcccgtctggcgatctcgcctccgatctggatgcggaaactgcgggatgcacgccaggaatctctcggattgatttcggtgcggacggattcctcgatcttgtcgtaaagacggtcatcaacagcaatcccctttaattttgattctgtctccacgcaccggaaaggtgtgggagccgcaacgccaaacgctattttcacatcgttcagtgtccgggcagacagatcggtcctgcacaggacgcagcagctcagcgctgcaatatccatggcattcctcatggcatatttaatatagtgcccggtataaccttcgtaatttttcttgtcgatgaagatccgggtcagtatttctccgtctcttaaatctacccggcccggtcccagataaaaatcttttatggggacgatccgctctccgccgggaccggaaatcttcagccgggcatccagacaaaaacaggcaggtgcactgtctgcgctgacggctccgttgcagagatttccgccgatggtgccgatattgcggatctggggaccgcctacctgatctgccgcctctgaaagcaccgggatatattgacggatcaccgggtcctctgtcaaatgatgaaaggtgacagcagctcctatggaaattgttccgtccttttccatggaaactccatgcagatctctgataccccgtatactgatcaggctggagcctgccagtttcccttcccggatgcggatcagcacatcgctgccgccgcagatgagtatggcgccgggatgtttttgtaagagatcacaggcatctgccacggtgtctgcttcataataatcttctatatcatacatatatttcccccttatatcaaatcagctttttttaatgcctcaaataccctctgaggtgaaagagggatttcattgaccggaatcccggttgcgtgaagaaaagcattgcggatggccggagcaggagggattgcgggaggctcgccaagagccttgtttccgaacgggcccgttggatcttcaagttccacaaagtctaaatggagatccggggagtccatcatagtgggaagcttgtagtctaacaggctgccgttcagtacgcgtccggtcttttcatccaggagcatctgctcactcagaccatagcctatgcccatggacatgccgccgtggacctgcatggaggccagctgtggattgatgatctttccgctgtcatggacattgatgatatcgagtatcttaatcttagctagttttaaatctacttcaatttccgcaaaacaagctccgaacgcaagggtgtttttcttgatctgccgggatacatccgacgtgatggcggcagaagaagtcctgctgtaatagctgtgaaaagccagttcttcaagggacaggaccggcttccgaccgcagaggatctgtttatcatacagagaaagctcctgatccctgtattcttcagcaaccagagtcctggcataggtaagaattttttctttcaggagttcggcacattctttgacggcggtgccgctgatataagtttgtctggaagcgtaagctcccgtgtcaaaaggggtaatgtccgtatcctgaaaggactgaatgtggacgtcatcaggggaaagacccaggacctccgccgccatctgtgtaaatacagtgtcggaaccctgcccgatttctgcggcgccggtctggagctggacactcccgtcctgattgaggataagcctggctccggatatttccagggaaatgggccatacaccggtcttatagctgaacaaagccatgcccacaccgcgccggatattcccggactggttttggtataagctgcgtttttcctcccagtgtatgtagtctgctccgcgcctcatacactctctgacgccgttggtgtttgcggcgagaggagttaaaacaggatcttcaaaatatccgtcatataggttgagctcccggaactttaacgggtccatggaaattttacaggccagatcatccatcagacattcggatacgaagcagaactgggggataccatagcccctcatggctccgcctaccggtgcatttgtatagacggtataagcatcggcccggatattttttacatcatataaatggcgccatgcggtagcgccgttggctgcgatggcatggccgtgtgaggcgtaggccccctggttggaataggctttcatatctttggcgagaattttaccgtcttttgttacgcctgccgtcaggtcatattcaatggaatggcgggtcctggtgtttgtaaacgtttcctctctggaaagctccagtttcaccggacggccgccgacagaggcagtcagaaatgcattgagaggttcatagagaacctcctgtttgttgccgaagcctccgccgatatatggctttatgacacggacttttccccatgggatgcccaaggcctgcccgatgactctcctcacgatatgggggatctgggtggaacatacgacaacgatcctgtctttttccatgtaggcataggaaatcggcggctcaatgtggcagtgctggacgataggggtgcggaaactttcgctgagtacggcatctgcctgcgagagtgcatcgtccacatgtccgatctcgtagctgctctttgcaagaatattgtccggatgttcttcgtgaaccggcggaatggttcccttcatggcatcccggggatgaagcaccggggcatattcttcgtactctgtccggatcagttttaaagccctggaagcggtgacttcatcttcggcgatcacggcggcaacatcgtcgccgtaataacggattctaccggtcagcagacggcggtccgccgtatcctggtgagacggctctacggaccagggatggccgggagtgggatatgtatgttttgggacgtcacggaaggtgacgacttttactaccccttcgagggcctccgcctcacttgtgtctatagaagcgacaataccgctggcaatgggagcatgcagcactttcgcagtgagacaatgcttcgggatcagatcatcggtaaatttggctcttccggataccttctcgtaagcatccaccctttttatgctttgaccaacagttctcataggcagtccccctctgaatataaaatacctgagcgttctctaacaacattctatgtaaaagaatgctgtcagagacgcccaggccacgatcttttaattgtaaataaattgtaccaaattccatacaatgtgtcaacgaaagtcagctgacgcatgaagcggggaaacgctatttgtggaaaatgtaaacagtaacagattccgcgtaaaagattttatctttgacggttcctttcaaaagaacgctgcggtcctttttcagatcctttaagctgcctttccggtagctggtttttgttccctgattataggcatcacagacagtaaccttcagatcttttttatattttactgtgatatgaataccagtgctttcggcaatctgtccgccgtttttcttgtcatcgtatgtgttgatcttgctgatcacaaaggtttcttttcctatacttatgacagtgccgttcagttctttcttttccacagaagcgccgtctgccttgacgctttcactgtctgtattgacagggtcagacagaacgatgatatccgcattcctgccatttttaacaaaccaggcagaaactttggaatgtttttttacagatttcagctgggataagctgtatcgtttatagacagtattaatctgatgaaaactggtcttctccttttcaaaactcaaatggaagacttttgtctcaggggtgatatttatgacagaaggatcgccgaatgcctcatctgtgtcgctggtgcaccggagctttctgtcacttccggacataaagtaaccagtataatcaggctctttttttggtatgtcctccccgcctatgactgaacttttataatgcacgagacccaggcggctcccgaattccacataggcgatggcacccgctccggcaaatgaaaggagtccaaggatcaggctgataagatagatccggtgcagatctttcctgcacagagccgacagaatatgaaaacagagaattcccgcggcagcgccgagtacattcagaagcaggtcgtcaatgtcggcagaaccaagataaaaaacatattggctggtctcaaagaagagacttaaaagtgccgacaggaacagaatctttcgtttagaaatcttcgggcttttcaacagagcaagaagataaccaaaagggaggaaaatcaggctgtttcccaaaagatttgatatgctccacaaaaaattcccgctccctgcaatacgggaaaaattaagaaaggtctgaaaaggaatcagattgaatgagcggaatccctttttctcaccggtcaaaaattttggaacagcagagaggtccgtatcttttaacagaacgatcttgatcaaaatcagcagataaaataaaaatactgcccagaaaaatcgtttgaaatatttgtttgttcttgtttgtttttctttgttcatagtgatctcctttgctatgtgtggagatcaggcaaaacggaatcattcagatctggtaatttcaaggtgctgaatgaattttccgttgtttgtataggagtttaaaataatattaggataggtttccagtatcttatggacgatcatcagcccattgccccggcccagtcctttatctgacaagccgggcactacctccttctccctacggacagagtttgagataacagcctcatacatatctttatttgaaacgaaccggatatcgatttgtttgtccatggtaagtgcggcttcctccatggcattgtcgagaaaaatccctaaaatgcggataaagtccagaaaatcaatgctgtctgtgatcaggctttctttaaaaacaccgtcgaacgacaggcggatatctaagtgctcccgaaagccggcagagattttataatatagaaaagctcggagctgttcatcgtccgcctgctgcagctgggcatataaatcatttttcttaagctcatcctgaaaataaggattgacggtttgcttaaaatattctttcagaggttcatcatggctgttctcaatcagatggcccagagtaaaaaggatatttttcatatcatgctttaaatttctgatctctgtcaggtttttctccagatcattgctgtacaaaaggaggttttcctcatagcgccgttttgcgtcgatggtaaaacgatacttggaaaacataagaagagttgccaggatgatgatctggatcagcaggacacagactgttatcgtatccatacaattcatgatctggtgataaaattcagaataatccgccgtataaaaaagtgtcataaacatggagagctgatattgaaaaaccagagccagcacaaataaacaaacggtacatagaataaaattccgggcgatcttcggataagacttctccagcactgaaattttaaccagatatcttccaaaaatttttctgatcagcaagatcaaaagggtatccagcaaaaccacagcagcggacagaagaataaagatccctgctttgaccagatattcagtctcaagcccgtttgcatagcggaaataaaaacctttgaaagagtcataaatattccgaagaaacacacggtttgccacatacaggataaatgtgatccatgaaaacaaaactttgcctttctgaagctcttttctgtagtagccgataccaaaaatcagaaagaagatcaggaaatctgaaaatccttcaacaaagtccggtttcgacacgaccatgaaaatgacagtaaataacagcagaaaatcggggagccggaagcgcagcagatttaaaatggcgatagacagaacagaaacaaggctgatcacgaaatactgcatagccgtagtaccagtcattaacagtattctcggaagctgcgtgtaccatatcagccccatgactgcgggataaagcagccacaggatttttttagctttgctttccatatatgactccttttatttcatttctctgccggaaggaacaggggaccgtatccccattgataaacttgatcattccatcggagagtccgatcatatggcacttctggacaatgacggagcggtggctcttcataaagcctgcgcctaaagtctcaagtgcatggtcgattgtttctcggactgtaatggaagaaccgttcactgtatgatagcagatacagtgggactttgtcttgactgcctccacatacaggatatcggcttttggaagtgacagttcctcatcggtgccgatttttaaagtgacagtttctgtatcctcttcagattccttagagggaaagctttttttggccagatagatatactgatagcagcactggttcattttcataatgtctgtggtcttttcgataaagccaaaaggctccactccggatttcagtacattgagtgccagttcatagtggttcgtcacaaatacgatctttgagccgggaaaactttttttgatctgttttgctatatcaattccattaaattcattgcttccaaaatccagatccagaaaaaaaagatattcaccgggatgtttctttaaataaagaaacagttcctgatagccggaggcaacacatgcaatccggccttcggggatggactctgataaaatgtgttctacctgttctctgatgatctttaaaataaaaggatcatcatcgcagagaatgatttctaacataaaactcctttctgattgcctgatctcttttgtttcctatacaggaactactataagagaagaaaacaagaatgtcttaaaaatatcctgtgatacctgggacagaacgtgaagttttaaggattgattacgttcaggacaaagaccgtgcattcgggatatttgaaatattttaaaaaagtagtacaataaaaaatactgtggtataagtagaattatatgtgacccggccgcaggatgcaatcatccaaagaaaggaagtaagaattatgacaaaaatagatatcatttcaggatttttaggagcagggaagacaacgcttattaaaaagcttttaaaagaggctctgggacaggaaaaggttgtcctgatcgaaaatgaattcggcgaaatcggcatcgacggcggatttttaaaagaggccgggatccaggtgacggagatgaattccggatgtatctgctgctctctggtaggagactttggaacggcgctcagagaagtagtttcacagtactccccggaccgcatcatcattgagccgtccggtgtgggaaaactgtccgatgtgatcaaagcagtgcagaaggaagcagaaaactgtgatctctcactgaacagctttgtcactgtggcagatgcaaagaagtgcaggatgtatatgaaaaacttcggggaattttacaataatcagatcgaatacgcaggaactgtcatattgagcaggaccggtcaggtaaaggaagataagctcggacaggcagtcagcctgatcagagaacataaccataaggcagccgtgatcacgacgccgtgggagcagctggacggagagaaaatcctttctgtgatggaagagggaaaccagctggaaaagcagctgtttgaggaagaagaaatctgtccggagtgcggacaccatcatgaacatggagagcatcatcaccatcatggagaggaacatcaccacgaacacggccatcatcatgcggatgaagtgtttacaagctggggggaggaaacacctcacaaatatgagaaagaaatgctggaacagatcctgaagaagctggcagagtcagatgatttcggcatgattctgagagcgaaaggcatcgtggaagggccggatcatacatggctgcattttgacatggtgccgggtgagtacgagatccgtcagggagaagcggattataccggcagaatctgtgtcatcggatcagatctcaacacggaaaaaatccaggccctttttgggcttaaatagggaggtaaaaaactatggaaatgccggtttacctgatatggggatttttagagagcggcaaaacttcttttataaaagacactttgaaccaggaatattttgcggacggtgagcggacgatgattctttcattcgaagaaggggaggaagaatatgaaaaagagttcctggaggaaagtaattcctttgttctacagatagatgacatagaagattttaccccagcctttgtagaaaactgtgagaaaaattaccatccggaccgtattatgatcgaatataatggaatgtatcagatcgaggatgtcatggatgtgatcgatgagacagacctggaattgtatcagatcattgtcacggtggatgcgtctactgcggatctgtatttaaaaaatatgcggtctctgatggtggagatgttcaagatggcggatatggtcattttcaaccgctgtaccgatgagaccaatgcgtcctcctatagaaggagtattaaggcagtcagccggagggcgcaggtaggatttgaacgggcggacggaaaagaatttgaactcaatgagatgctcccgtacgatccggaggcagagatcatcagggtcaatgaggatgattttggaatctggtacattgacgttttggagcggcccaatgtttatatgggcaaagtggtggagctttccaatgtatttgtcagaaggcctcatggaatccctgccgggctgatcctgccgggcaggtctgctatgacatgctgtgaggacgacataacatttatcggtttcatctgtcaaatgcatcatgtcaagtcctctacaatgaagaaaatacaggatggttcctgggccgtgctgacggcgaaaatcagtatggaaaaccataaagcgtacggaggagagaggggccctgttctaaaggcgctgcgcatagaacagggaacacagccaaaagaaaagctgatctacttttaagcagcacatcgtaagaaacggagacaaacgtcggccgtttggcctgaacgtttgtcccttttttatttggggcaggatgatgctcaacacaaggtttttttgttacggttcttttttttatctttatactgaaaattagaaaaaactgaaaggataaaacaggagggactagaatgaaaagaaaaagaatatgcttgctgatcatcatttttgccataggattgtgggcaaaaggcggagagtggtttcctaaagacatcccatttggagatgacgttttcaaggaggtatcagacttaaggcaggtctcagatcaaaagatttacagcgatgctgcggttttggcagaacaaaaatccggcaggatcctaatgaataagcagggaaataagaaaatatatcctgcatctttaacaaagatcatgacagttctgctggctgtagaatctgtttctaatgatgaaaaggaaatcctgatgaaccaggatatttttcagtcgctggcccaaagccatgcctccgttgcaggatttctgccgggggagagagtaaagataaaagatctttattatggagcaatgctgccgtcaggagcggagtgctgtctcaggctggcaaattatctggcaggaagtgaagaaaagtttgccctgctgatgaatcagaaggcaagggaaattggaatgaagcacacaaactttgttaattcaaccggcctgcatgatccgaagcacgtttcaacagcagaggatttggagatccttctccggtatgctctgaaaaatccccggtttagaaaagtgtttgagacaatgcagtatcggacagaaccaacacaaaagcatccggaaggacttcttctgcaaagtactctgacagattataaagaccagctgaagccaacgaacggaagttttctcggcggaaagaccggatatacaaaagaagcaggactctgcctggcaagctgggtcaatatacgcggaaagaggtatatactggtgactgcgggtgccagaggagaccatcagacaagaccgtttcacgtgctggacgcagaatctatatatcaagaattataggaagtctaaacggatattcccctgcatacactgtaaaaacagagaatgcaggggatttttatgaaagagtacattgaagaacgcgcggtagaagtcggcaattatatcgtagataaaaaagccacagtcagacaaactgccaaagtgttcggaatctctaaatctaccgtacataaagatgtgacggaacgattggaaaagatcaatcagtccctggccagaagggccagagaggtactggatctcaacaaatcggagcggcacatacggggcggcatggcgacccgtggaaaatacgagaagattaaaaaaaatacaaaagcaattcaggggtgaattgcttttgtatttaagatacggtatgccaaagaaggcagcacttttatgggtcagcggccggcgttgacatttcccgtctgattatgtaggagctgttcattgaacttcagcagggaggataccggttttgaaagtgtcagatactgtcttgtatgacacctgagcgaagactttttctgagcgtataacttttgcggagtaaaaaagtcagagccctcaaacggtgtcctttttatagaaatatcaatcacgatatctaaaaaacgattctggtgaaagatcttcctggtacactcctttttataagtaggatggagcttgttgatggtgaactggaaatacaaagaattcatcgccggctcttcactgtccagcaggaattgataatctccgctgagaattttctctacttcttcctgtgtcagggaaaactttgtcttatggaccacatgtccgctggtctgattctgaatgaagaaaaagtttgtgtggtcttcttcataaatatagtaacggatattcggttctctctcaagcccctcaaacatcaaaactcttacgggcatgcttatcatgtatttttcaggagacctggacagcagatattcctcctgtatcttttcgtattctgtctgactgatatttttgttgacttcggtgtaagaaagcttttctactaatattttacccataataactccaatacgcagttttggtttattgtttcttatcaatatactagtgacattatatcaaatcgtgcatataaaatcatgacttatttctaaaaaaagtcttaaatttgcgtggattttcatcggtctctatgttaagattaccaaaaaggaggagctatggatttatttgattatgcaagacagaaaaacagcaggaaagaagctccgctggccggcagaatgcggcccaaaaccctcgatgaagtcgtgggacaggagcatattatagggaaggacaagctgctctaccgggcgattcaggcggacaagctcagttccatcatattttacggacctccgggtaccggaaaaacgaccttagccagagtcattgcccagacgacccaggcaaacttcgtgcagatgaatgctaccacttccggcaaaaaagaaatgcaggaggccgtgaaggaggcaaaggaagcactggggatgttccagaaaaaaacaatcctgttcattgatgagatccacaggtttaacaaagcccagcaggattttttgcttccttttgtggaggacgggacgatcattttgatcggcgccactacggaaaatccgtatttcgaggtgaatcaggcgctgatttcaaggtccaatgtctttgaacttaagtcactggaaccagaggacattaaaaaacttttagtcagagctgtgaccgatgacgagaagggcatggggatttaccgcgccaagattaccgatgaggcccttgatttcctggcagatatggccgagggagatgcaagaagtgcgctgaatgccgtcgagcttgggattcttaccacagaaccgggagaaaacggagagattgttattgatatcaatgtggctcaggagtgtatccagaagcgggtcatgaggtatgacaaaggcggggacaaccactacgatattatctcggcatttattaagagtatgaggggatctgaccccgatgcggcagtttattatctggccagaatgattgatgccggagagagcgttacctttatttcacggagaatcatgatctgcgcttcggaagatgtaggaaacgcagatccccaggctctgcaggtcgcagtcgcggcatcccaggctgtggagaggatcggacttccggaagccaggatcattcttgcccaggcggtgacctatgtggcgggagcacccaagagcaatgcggcttatatggctgtgaaccaggcattggaagctgtcagaaagagaaaaaacgggatggttccaaaccacctgagggatgccagctacaaaggggcttccaaactgggccggggaatcggatatcagtatgcccacaattttccgggacattatgtcaaacagcagtatcttccggatgaactactggggaccgtgttttatgaaccgacagagaatggatatgagaaaaatattaagaaatatttggacagcctgagggaggaatgaggcatggacagtttacaggatggatatatgctgagaaacggagtaaagataccgtgtattgggtttgggacatggaagtctcccgacgatgtggtctgtgagagcgtgaaaatggcgattcaggccggataccggcacatagacggtgcagccgcatatgccaatgaggcaggtgtggggaaaggaatccgtgagagcggagtgcccagggaagagttgtttattacaagcaaactccccaatgcagatcatggatatgaaaaggcgaaaaaatcgtttgataaaacactggaacacttaggtcttgactatcttgacctctatttgatccactggccggttgtgatcgagcataaggatgactatgagcaggatattcttgacacatggagggcttttgaggagctttatggggcgggtaagatcagagccatcggtgtcagcaattttatgatcgaacatctggaaatattaaagaaccatgcaaagattatgccgatggtcaatcaggtgcagcttcacccgcagcatccgcaggaagagatggctgcttactgcaaagaaaaccagatcgtgccggaggcgtggagtccgctgatccagggacaggcatttaagagagaactgttaaaagaaatggccgcaaaatatgaccgtaccgtggcgcagatttgtatccgatggatcatgcaaaaaggagtgatcccgctgccgaaagcatccagtatggagcgtatcagcggaaatgcagatgtctttgattttgagatcggggaagacgatatggaaaagatcgcgacgctcagaacttatgggatgatcggggaggaaccgagtattccgagaacaagacaagtcgtaggattttaaaaacagaaggtgcattccgaggatggaacgcaccttctgtttcagtctttgttttttttgtatagaaagataagcacccacaggagcagcggatagaagaacatcagcgccagcataccatagaatgctccatttccggtaaatgcacaaaacagagtgaggcctatgacgagaaaaatggacaggatcacaaggatggacaggatacgttttgttttttgtttcatgagcctttcctttccaagacaagatctttcaggtttgtaatttcagaatcgggcagcccatgttctgtaagataggacgtaaggtgaagttcttcaaacaagtgaagcagctgttccatatgggcggcatctgagccgagcatcggaagcatggactgatagtcaggaagttccatggctgctttgttaacgccgcgctgattgtatgtaaaggaaacctgatattctgcaacgatgtcttctctgtcagcaccaagaagtgtcaagagtacggcagaaagaacaccggtccgatctttcccggcggtacagtggaacagaaccccgcctttgttaagacactgaacgacggtttttactgcgccggcaatcagctcaggactgtcatacagcattttctgatagccgtctgccagacttttcgtgaaggctttggaagcagattctgctgcattttcaaagtcaatttcttctttttgaaggggacagtgataatactgcattgtctccggaacctgatctttcatgaggagcgtctcggatttgctccgaagatctataatagagacaattccaaagtcctcaagctttttccattcgtctggggagaggaacgcaagacagtcaccacggtacaggcggttccagcggatgacggagccatccgcggtttccaggccgcccagatccctgatattaaatgcatgttctaaccggattctttttactggtgtgttattaaaattcaaaagataacctcccgcacaatagatttgtttcttctattctaatgggaagagaaagaagatacaaggggttattttggacagagcgtgacattcttctctatagaaacagatactggaatgcattgaaaaagtatcctacaaaaataataccaagggtacagatgactgcaaaaatcaagagaagctttggtttgactgcttttttcagcatgattacagatggcagggagagagtcgtaaccgccatcataaaggacaggacaacacctaactgggcgcctttcgagagcagtgcctctgcaacgggaatggtgccgaagatatccgcatacataggaatcccggcgggcacagcgatcagaatgcccaaaggattcccttttccgagaatttttataatcaaggtttcaggaatccagttatgaatcaccgcacctatggcgacacccgccaaaatatatggagtgaccccttttactgtaatttttgctgtctcccatgcatatttgactctgtctttaaaacacagagattcctgcggcacatccgggacatgatcagatttgttaaaatcccggatctgatgctctaaatgcagcttttcaatcacggtgccgcctgccactgcaatgacaagtcccagaaggacatagacgagagctacttttccgccaaagatactcgttaaaagcacaagtgatccgagatctaccataggggaggatatcagaaaagagaaggtaactccaagaggcagtcccgcatttgtaaaaccgataaaaatcggaatagaagaacaggaacaaaacggagtcacggtgcccagcagagcagcaatgatgtttgccctgataccgtgtaaaccttcaagaattcgtttagttctttccggcggaaagtaactttggatgtaagagatcaggaggaccaaaattcccagcagcaccatgatttttacggtgtcatatagaaagaacaacatactgtttccgaccctggatgaggtatcgagtccaagggattctaaaagattttttatgattttgttcagccaattcattcccagtatttcgttctgaaagaaatcccacattgattttattgtttccatgttattaacgtcctttctgttatatagataaatagaaatgtttcgatgtattgtatataaaaatcttacaggcacttttgtggattgcccagactacaattaaatttttacgatattttttcgccggtcagttcatgcaaagtccgaatggcaagggacattccttcagatgaaatggaatagtaggtccatttgccttccctgcggcccgatacaactccggaatcacacaaaattttcatgtgatgggacatggtaggctgcgaaacattaattttttcattgagctcacaggcacatttttcaccagtaactaaaagttttagaattttgatgcggttttcatcacaaaaagctttaaagacggcggaaaccttcttttcattaatctccaattcagatacctcccatagatgcttatctatatttactatatgacaaatatagatatatgtcaatgtgttttggagactttacaggcgttgcgggaaatgaaggaaactgataaaataaaaaaacatgcagaaggccctgtaacacaaggcctcctgcacgtcaaggggaggataagtaatctaatctgttgattagacattaagagtatgtcccctgtaattttttttatacacagattgaaaaaatattttaaatttgttatagtatcataagtatcacgaaagcaataaaaacagttaaaggatggataaatcatgggattacttcaggaatggcgcgactatgcgtataaatttgacgaccgtacacaggaaggacagcagttctggctttcttattttgggatcgaaaaagagatttatgtaaagttattatcagataaagactttgtagaaaaaggaacagtcaaagaactggcagaaaaatatgagacggaacttcagttttttgtaggttttctggacgggatcaatgacagtctgaaaactccgaatccgatcgaggagatggaagaagatacggaagtaacgttagatatcgactttgaaaaattatactacaatatggttgcctgccgtgcagaatggctgtatgaactggaacagtggaacgatattctgtcagaggagagaagaaaagagctgtataaagaacagaaatcatccacgacagttgtaaaaggcgagaagatcggaagaaatgacccgtgtccctgcggaagcggaaagaaatataaaaagtgctgcggaagaaatgcatgacattttccacatgatttccgttcggctcttagaatgcctcactccaatcatgtggaaaatggacataatgtctgttggagaagggcctctgtcaaaaaaggtgccacttttcgaaagttatttaccgctattgtaggagcgcatttcaaaagcgcgacggaaatagtggtaaataactcatgacattttctacatgatttccgttcggctcttagaatgtctcactccaatcatgtagaaaatggacgtaatgtttgctggagatggtgcctttcaaacaaaagatgctgtgctctggttgtgctgtaatactgtttataacacccgaaaagttgtcaattaggtttggcagctttttgtttatagacagaattttcttttgattttgctttttaggaaggtaagaattatgaaaaagagagatgatcatattacatggaggaagcttgacaatacggcccagctttttccggtgatcgcaaataaggagatcagccatgtttaccgaatttcggccacgctgaaagaggaggtgcgtccggatctgctccagcaggcgctggaagatgtccttccgtggtttgacgtgttccgggtgcggcttcgcaggggatttttctggttttattttgaagaaaataagaaccggcccgaagtagaggatgagaccgagtatccgtgccggtatatcgatccccatggcaggaggaagtttctgttccgtgtttcctattacagaaggaggatcaatctggaagtattccacgctgtctcggacggtatgggagccatcacgttcttaaaggaactcacttaccgctatattgacctgttcaggaacgagtccaaaggagaggtgaaaaaatattcacccagcgaagaatgtattttggatcaggaagacagctactttaagcattaccgaaagaaaaagggaaaaggttacagcacgcaaagagcctatcagatcaaaggaagaaggatttacggaggcgctatcagcgtcattcacggctatgtcagtattgaggatctgaagaaaacctgcaggagctgcggggtcagcgtcaccaaatacctgactgccgtattaatatacagtatctatgaggaatacatgaacaggcagcaggacaaaaatccaatcggaatcaatctgccgatcaatttaagggctttttttgactccagtacgaccagtaacttttatgcggtaaccttgatcgaatttttatccaggggggaaaatcatacatttcaggagattctctctgaagtcagccggcagatggacgaaaagattaaaaaggaaaagatcgaggaggtactgtcttataatgtttctgcagaaaagaacccatttatacggattctgccgcttgttttgaagaatctcggactcagttataagttcaggcgttccagcaagtcagcgacgactacgctgtccaacctgggacagatcagggtgcttcccggatatgaggatgagatcgagcaatttcatgtgatgatgggtgtcttcaagacacaggagatgaaatgcgccatgctcagttataaggaccaggcggtcatcacatttacgtcggttttccaggaaagctatctgcagaaagcctttttcaggaatctggcgaaggaaggaatcaaagtagccatagaaagcaatggggtaatcaatgaaaaggtgtaagagttgccaggtggaagtcctggatgagaccgtgacgtgcccgctctgcaacagggtattaagtgatgacggaaaaaccgttaagcgggagagaatgtaccctgatccggaagaagaaagaatgaggctttacgggattaaaaatatttttttcatcctgctcggtatgattgcagtccttatgggaatcatcaattatattacatataatggatttctctggtcggcaatcgtccttgcaagtattttatatctaatggtgactgtatcctattccattgtacacaggagaaatctggccgcaaaaatcgttgtggaggtcatcggcggaggaattctggtatctgtcattgactatgtcatcggatatgagggatggtctgcggcttatgtcataccggggctgatcctgacggcagatctggcagtggtagtgctggtactggtaaacagaaagacatggtacagttatctgatgtacttgatttttatagcggtcttgagtgtggtaccggtcatcatgtacctgttcggactctttgaacagccgctgatcgcatggatatcctgcggaatttcagtactgacggtatttgttattttagcggcagggaacaagcaggggaaaaatgaactggccagaagatttcacacctaatcagagaaggagcatactatgaaacgagcaagtttgcgcggacagatggccgttcaatgcatcagaggatttacagcgacacccagaggaaggacatatgccaccggcatgggacatcagaatccgaaggaataccggtggaagtgcccaaaagggtatacaaacgagaaactggcacatgagaattttcagatggaatttctgtctccggatcaggataaaaatgacctggcggtattgcagctgcacggcggcggatatatcgggacgcttagaaacgcataccgcagagctgccctccagtactctatttgcagcgggggaggaagtgttctgtcaccggattaccgggtcgtgccggagcatccgtttcctgcggcgcttaaagacgctgtctcagcctaccggtggctgacagaggagaagggattcccgccggaaaagatcgtgattgcgggggattctgccgggggaggacttgcgctggctctcggtttatatctgaaggatcatggaattgccatgccggcaggttttattttgatgtcaccgtggacggatcttacactgagcggagaaagtctcaaatataattacggaagagacccgctgttcggcagatcaaaggtcacgatgctttacgattctctgtatccgggaagtgaggatgtcagcaatccgtatatttccccgctgttcggagattatcacggatttccgccgatgctgtttcaggcaggcggcagggaagttttgctggacgacacactgagagtggcaagaaaggtgaaggaaagcggtgtttcggtgagaaacagtgtctatcccgacatgttccatgtgtttcagctggcgatgggaatgctgccggagagcaaagaggcctggagagaaatcaggacctttttcagaatgattttcgggacgaaaaaacgtcactgaatcttcacaattcttttcttgtatttccatttgcactgtgctatgataaccattagtcaactaatgattagataactaatatattttttgaggtttaagaaaggagtcatcatgtatgaagatgacggcatttatcacctgcttctgaagatcaaccataaaaattttgcaatcggatttgcttacctaaaggaggcaggtctgcatccggggcagatgccgctgatcaccggcctttacaagaaagaaggagtgactcagaaggagattgcagatagattgggcattaagccttcgacgatcaatgtcatgatccgcaggcttgaaaaaagagaatttgtcatcaggaagcaggacccggaagatcagaggagaagcctcgtgtatctcacggaacacggacggcagatctatgagaaaatttccgaagctaccgtcgaagttaaaaatcaggtcatgaagaccttcacggaagaggaaaaagaagaactgttccggctgctcacaaaattttatgaggggcttgataaattagttgatttggaaataggaacttgtaaatgtaaggaataatcgtagaaaggagacatcatgctgaaaatattccgatatctgaaaaaagcatatatcccgatcgcatgcattgttttgcttttgtgtgtgcaggtcagctgtgaactgacgatcccgacgtatacgtccaatattgtcaatgtaggaatccagcagggcggaatcgaggacgcagtgccggatgccgtccgggaagagtccatgcaggcactcatgggaatgatgaagccgaaagatgcagaaaaagtgaaggatgcctatgagctgtacacgaaaaaacaggtgaaagactctgattacagctcttataaaaaaggccgtctctatgtgagaaaagacatcagtaaaaaggacagggaggatttagacaaaatcctttcaaaaccgatgctgatgctggaaatgaaaatgatggagcaaagcggccagaccaaagaaaatgccaaaatggcgcagaaatttaagggaaagagcattgatgacatgccggaaagcatcatcagccaggccgcgatctcttttgtaaaagcggaatataaagccatggggctcgacttagaccagatacagaccaattatatgttgaagaccggagccattatggtagggcttgcactgctggctatggctgtggccgtaactgtcgttttattatccgcaaaactggcagccaggctgagcagaattctccgtgaccatatttttaaaaaggtaatggattttacgaactcagagtttgataagttttccacggcatccctgatcaccaggagtacgaatgatatccagcagatccagatgtttgtgaccatgatgttccgcatcgttgtatttgcaccattgatggggcttggaggtatctataaagtactgaaaaccaacgtggatatgacatggaccattgccatcggagtcgtggcgatcatgaccgtgattttagtcctgtttactgtggctatgccgaaatttaaggttttgcagaaactgatcgaccggctgaaccttgtatccagggaaattctgaccgggcttcccgtcatccgtgcattcagcaccgaaaagcacgaaaaagaacggtttgacacggccaataagaacctgatgaagaccaacctgttcgtcaacagggcgatgacgtttatgatgccgctcatgatgctgatcatgaatgccatgacggtcctgatcgtctatgtgggagcagacaacattgacctgggaaggatgcaggtgggagatctgatggcgttcattcagtatgcgatgcagatcatcatgtcattccttttcatctccatggtttccatcatgatgccgagagcccaggtggcagcagagcgtgtcaatgaaattttagatatggagatcatgatcaaagatccgaaacggccgaaagaatttctgagtgagaaaaagggagaagtggaatttaagcatgtttctttccgatatcccgatgcaggggaggatatgctccacgacatcagctttacggcgccgtccggaaagaccacggcgtttatcggaagcaccggaagcggaaagtctacgctgatcaatctgatcccgaggttttttgatgtgacagagggaagtattctcgttgacggagtagatatccgggaggtaaaacagtcggatttaagagataaactgggctatgtaccccagaagggggttctgttttccggaacgatcgactcgaacctgcgttacggaaaagaggatgcatctgaagaagaggtgaagaaagcggcaaggattgcacaggccgcagatttcattgaagaaaagaaagaggcatatgattctccgatcgcccagggaggttccaacgtatccggagggcagaaacagagactgtccatcgccagggcagttgccaaggacccggaaatttacatttttgacgacagcttttccgcacttgattacaagacggatgtgacacttcggcaggcactggccagagagacgaagggaagcacgaccctgatcgttgcgcagaggatcagtacgatcctgcacgcagaccagatcgttgtcttagatgagggccgcgtcgtgggcacaggaactcatgaagaactgctggagtcatgtccggtctacttacagattgcaaaatcccagttgtctgaggatgattttgcaaaagctagaggggaggcggcagaacatgagtaatcagaacagaaggccggtcaggagaatgggccacggcccgatgcagggcggagaaaaagcaaaagatttcaaaggaaccattaagaagcttttaaaatacatgagacgctactacggcgccatcgcttttgttattttgtttgccattgccagcacggtatttaacattgtaggaccgaccatacttggaaatgccacaactgaaatttttaacggactggtgaaaaaagtccagggaaccggcggaattgatttttccaagataaggggcatactgctgacgcttctcggactgtatctgacatctgcggcattttcattccttcagggactgatcatgacccatgtgtccaacaacaccacatatcagatgagaaaagatatttctgaaaagatccacaggatgccgatgaaatattttgagagcagaacattcggtgaggtgctctcaaggatcaccaacgatgtggatactctgggacagagtctgaatcagagtatgacacagatcattacttctgtggctaccattatcggtgtgttcgttatgatgatcaggatcagcgttccgatgacggtcgccgtggtcgtgatccttccggtatccttcctgatgatcggtgcgatcatgaaaaaatcccagccttatttccaggcgcagcaggcactgctcggggaagtcaacggccaggtagaagaaatttacagcggccacaacattgtaaaagtattcaataaagaaaagagtgttgtggaagagtttgaaaaagtaaacggaaaattatataattctgcgtggagatctcagtttttctccggggcaatgatgcctctgatgcagtttgtgggaaacttaggctatgtggtcgttgcgattctgggaggatttctggcaatcaagaataccattgaggtagggcagatccagtcctttatccagtatgtaagaaactttacccagccgatcacccagctggcccaggtcggcaacatgatgcagacgaccgcggcttccgcggagcgtgtctttgaattcctcgaagaagaggaggaagaagaagtgaaggagaatcctgtggatgtgtcttcgctggacggaaatgtaacttttgaacacgtatccttcggatataatgagaatcagagagtcatcaacgatttctccgtggaagtcaaagaaggacagaagatcgcaatcgtcggcccgacaggcgcaggaaaaacaacgatgatcaaacttttgatgagattttatgatgtcagcggcggatcgatcaagattgacggctatgatgtcagagactttaaaagaagcgatatccggcagatgtttggaatggttcttcaggatacatggctttacaatgcttccgtccgtgacaatatccgatacggaaagctggacgccagtgaagaagagatccagggagcggcaagagctgcctttgcccatcattttatcgagacacagccgaaaggttatgatatgataataaatgaggagagcaataacatttcccagggacagaaacagcttctgaccattgcgagagcgatcctggccgaccctaagatcctgatcttagatgaagccaccagctccgtcgatacaaggacggaagagcggattcagaaagcaatggataacctgatggaaggaagaaccagttttgtcatcgcgcatcgcctttctacgatcaaggatgcggatatgatcctcgtcatgaaccacggggacatcgtagaacagggaaatcacgaggaactgcttgcgaaaggcggtttctatgcgaacctctacaacagtcagtttgaaacagcggactagaagggaatttatcttccggtcctgaaagcctccggtaccgtcggcgcatttttgccccggcgtgccagaggctaaattgcatttaggtataaggaggaaattatggtacggttggcatgtataggaacaaattttatcacggactggctcctggaaggcatccgggaggtcgaagggatcgagctttcagcggtctattcaaggacgatggaaaagggaaaagaatttgcggccaaatacggggtcgataaagtttatgataattatgaagaactggcaaaggaccctgagatcgatgcggtctatgtggcaagccctacttactgccatttcaaacacacgatgatgatgctcaaccacaaaaaacacgtgttatgtgaaaagccggtggcatccaatttgacggaacttgaattgatgatccaggcggcaaaggaaaatcaggtcgtgtttatggaagctatgaagtccgtacatacaccgggattcaaggcgatgaaggaacatctttccaagattggcaccgtgcgccgtgccacgatccagtactgccagtattcttcacgatatgacaagtttaaaaacgggattattgaaaatgctttcaagccggaactttccaacggagccattatggacatcggcgtgtactgcgtgcattttctcgcggcattattcgggatgccggaaaaaatactggcggatgccatattcctggaaaatggtgtggacggagcaggcacgctcatcgcatcctatggggataaacaggcggaggttatttattcaaagatcaccaattccaagcttccgacccagatccagggagagaaaggctgcatgatcatctcagagtgcccgaatccaagagagatcaagattctttataacgatggcagtgaagagaccattgaatgtgacagccgttccaacccgatgaattacgaagcacaggtttttgtagaactgatcgagacggggcagacagaccatccgcatctggaagcttcagtaatggaaatgaagatcatagacgaagccagaaggcagaccggaattgtatttccggcagataaaatcagagaacagtaaaggagaacagatcaatgaaaaagaaactgatcgcagggggactgctcctctgtacattagcgctttctgcgtgccagactgagaaaaagcaggagaaaacagaaaaagcaaagacgactgccgagaaatcgacggaggcaaaggtcctcagcaaatataaagagatcaagatcaacggagccaaaaagactgtgcagattggggacccgtccaaaggggagacggttgctattgtgaaagtcaagggctacggaacaatgaaatttaagtttttcctcaaggattccccgctggcagtcaaaaactttttgacgctggcatccaacggatattatgatgggattatttttcacagggtcatcaaagacttcatgatccagggaggcgatccgacgggaacaggaaaaggcggacagagcatctggggaaaagagttcaagaatgagacttctgacaagctgatcccggtgagaggagcactctgcatggcaaatgcaggtccggataccaacggaagccagttttttgtagtgcagaacagggaagttacagatgaaatgctggattcttctccgatagaacttacaaaagctcagagggatctttttaaagagcagggaggatacccgtctttgaccggagactacacggtattcggccagctgtatgacggatacgatgttctggacaagattgcccagactcagactgtgtcagatgcaaaggccgagaacaaacctaaaaaagacattgtcattgaaaaaatcaccgtaaagaattactagaaaaaccgccgggagggacagatgcttaccatcggactggatcacacaaaaaaagaaccgttttacaggcagatttatgcttatatccgggatgaaatacggagtggggctctgccctgcgggtccaggcttccgtccaccaggaggctggcaaagcatatggacctgagccggaatacgatcgatctggcctacggccagctgacagccgaaggatatattgaggcaaagcccaagcgcggatattttatctgccaggtggaagacctggcgtctttaaatattcccgtggagacagaggaggaagatccggtgcaggaggaagatccgatcccttttgatttttctcccgtaggagtcgacatgactctgttcccctataatgtatggagacgacttctgaaagaagtcatgatgaacgacaacagtgagttgttccaaaaaggagaaaatcagggggatttaggactgaggagggctattatgtattacctcaggcagtccagaggtgtccacgtgggcaccagccagattatcataggagcggggattgaaaacctgctgtttctcctgagcctgactctgggtaagggcaggaccatggccatggaaaacccggcatacctaaacgcctatcagacggtccgcgaactcggatttcaggtacttcccgtagacatggacgaggaaggcctgagggtttcgcagctggagcagagcggtgcggatctcgcctatgtcacgcccgcccgtcagtatcctaccggtgtggttcttccgatcggcagaaggagccggctgatcaaatgggccagagaaaaggaagaacggtatattatcgaggatgactacgacagtgagttccggtactatggaaagccgatcccggcccttcagggcatcgacgagagtgataaggtaatatatatgggtactttttctaaagcgatcgcccctgccatacggatcggttatatggtgctgcccaaaagccttgtgcctgcatacagaaagaccgcgggtattttctcctgtgcggtatccaggatcgaccagagtgtactcacctcttttttatcggaaggtcattttgaacggcacttaaaccggatgagaaatgtttataaagaaaagcacgatcttctgattcagaagctgaaggaaattgacagccggatcacagtttacggtgccggagcaggccttcatgtgcgcgttgattttcatattcaggatacagattggtttgaaaaagaactgctgaaaaggggagtcagggtttatcctctttcgatgtattatatagacggaggtcccgaaaaggagcagtatattttaggctttacgaaaatgcagaaagaagatatgataaaaggacttaaagccatccgggatgtttaccggctggcatgatattttctacaagaaatgaggtacaaataatgtctgaagaaataaatgaaacagaattagaagaaaaagaagtgcctgcaaaaactactgaggagaaagacgaaacccatgatgtggagcgctactgctatctgtgccgcaggccggaatcgattaccggaaagatgatcacgcttcccaaggatatacatatctgcgtagactgtatgcagagaactatggacagtatgggaaacggacagttcagctttatcgatgccacaaacatggacctgaacaatatggacttatcccgtctgatggaaaatatgcaggaaccgcctgcgcaggcagtgaagaaaaaagataaaaagaagaaaaagaaagaaaaaaaagaattaaatctaagagatattccggcaccgcacaagatcaaggctatgctggatgaatatgtcataggacaggattatgcaaaaaaggtcatgtctgtggcggtctacaatcactataaacgggtggtgaccaacaccatggaagagatcgagatcgataaatccaacatgctcatggtcgggcctaccggttccggaaagacgtatctggtaaagactctggcgaggcttcttcaggtgccgcttgccattacggatgccacttctctgacggaggctggctatatcggagatgatgtggagagtgtgctctccaagcttctgcaggcagcagataatgatgtcgacgaggcagaacacggcattatttttattgatgagattgataaaatcgcaaagaaacagaataccaacagccgtgatgtcagcggagaatccgtacagcaggggctgttaaagcttctggagggggcggaggtagaagtgccggtgggtgcaacaagcaagaatgccatggtgccaatgacgacaattaatacaaagaacatcctgtttatttgcgggggtgcctttcctgatcttgatgaaatcatcaaaaagcgtctcatgaagcagacatctatcggcttccatgcagacctaaaagataaatttgacaaagacgagaacattctgtccagagtcactgtggatgatctgcgggaatacggtatgataccggaatttttagggagactcccgatggtatttacgctggaagggctgtcaaaggatatgctggtccgtattctgaaagagccgaaaaatgcaatcttaaaacagtaccagaagcttctggagctggatgaagttgagctgatatttgacgaaagtgcgctggaagcaatcgcggaaaaagcgctggaaaagaagacaggtgcccgtgcattaagggcgatcatagagaaatttatgctggatatcatgtttgagattccgaaggatgacacgatcggaagagtgatcatcaacagggattatattttaaatcacggtacgccggtgatcgaactgcggggacaataacagaaaaaagccggatcatatgatctggcttttcgcctaatatttttgctgaggagatgatataatagctttatggaggattgtgtatgaatgattttaagtatttgaaagaattgtccaagcagtacccaaacatttctgcagcctctgcggaaattattaatttgcaggctattttaaatcttcccaaaggaacagagcacttcgtttccgatctgcatggggagtacgagaaattcagccacatattgagaaacggttccggggcgatcagggggaagattgacgaccagttcggcaatattttaagcatcaaagagaaaaagaatctggcgtctgtcatctattatcccgagcagaagatggacctgatggaagaggaattgtccgaagaagagctggattcctggtaccggaccacgctgatccggctgatcctcatggcgaagctggccgcaagcaagtatacgagatcgaaagtgagaaaagctatgcctccggtgtttgcgtacatcatggaggaattgatcacagaacacggaatgctggacaaggacgagtattttgaccagatcatcgagacggttttaaagaccgggcaggtcagggagctgatcgcagccctgggccatctgatccagaggctgaccatcgaccatctccatgtgatcggggatatctatgaccgcggaccgggagcacaccggatcatggactgtctgatggattatcattctctggatatccagtggggaaatcatgacattctctggatgggagcggcatccggacacggggcgtgtattgccaatgtggtgaggatcagcgccagatataataatctggataccctggaaaacggatacggaatcaatctcatccctctggcgaggtttgcgctggactgttataaggatgatccctgcgaactgtttacgatctcgggggatgtccaggaagaggatgtcagggagctggatctaaataaaaagatgcacaaggccattgccgtcattcaatttaaactggagggccgtctgatcaggagaagaccggatttcggcatggaggagcgcctgcttctggataagatcaactatgaaaaaggcaccatctgtatgcggggaaaagaatacccgttaaaggatactcattttccgactatcgatccaaaggatccgtaccggctgaccaaagaagaagagtatgtgatggaacatttgattacttcgttcaaatactgtgctcatttgcaggaacatgtgcggtttcttttttcaaaaggcagtatgtatcttacatataacgacatggtgctctatcacggctgcgttccgctgaatgcagacggaagtttccgtcaggtgaagatcaacggaaagaaatacgcggggaaggccctctgcgatgtgctggaacaccacgcccgccagggatattttgagcaggaaaattcaccgaagaaaaagtacggacaggatatcatgtggtacatatggtccaatgaaaattctccggtgtatggaaaagataagatggctaccttcgagcgctattttgtggaggaccctgacttgaaaaaggagacgaaggattattattatcagctgatcgaggaggaggcagtcctttaccagatactggaggagtttgatgccgacggcatgaaaggtcatgtcgtcaacggccatatgcctgtcgctgtcaaggacggagaaagcccaatcaaatgcaaaggaaagctgttcatcattgacggaggcttttcaaaggcataccagaaaaaaacagggatcgcaggttatactctcgtttccaattcttacggaattaaactggttgcccatgagccgtttaaatccagagattttgttatccgtgaagaaacagatatacattcagatacggtcctgtctaaaaaggtgatccgcaggaaacgggtcggggatacggacaacggaaaacgaataaaggaaagcattaaggatctgggctgtctcgtgacagcataccgaaaaggagaaatttcagaaagaatctaaggagcagacactatggaaaagacatattatcaggcacctacggctgcagtgctgggagacgtggaattgggagacggagtttctgtctggttctcctctgtggtcaggggcgacgaaaaccgtataaagatcggaaatcagaccaacatccaggaaaactgcacggtccacgtggaggaaggccatccggttctcgtaggggagcgggtgacggtaggacacaacacgattcttcacgggtgcactattggggatgagacaatgattggcatgggaagcatcatcatgaacggagccgagatcggcacacattgtttcatcggggcgggaagccttgtgacggaaggaaccgtaatcccggacggaagtcttgcgttcggacgtcccgcaaaggtggtccgtccggtaacagaagtagaaatccgccatatcagggaaagcagccggtattatgtggaaactgcacaaaatcatctcatagagaaaaaatcataatttcaatagacatttcataactattaagcaagattatttttagggagaattttatgccggatgcttgcattggtgcggcagtcaatgaaaattaccgcgattttatttccggattcaggaccagtccgaatgaacttcgggacttttatcacacagactgcatcactcaggtgaattttcaatatgcgatcgtctatgtagatgagcagcaggcggctgcttcccctgtctccaatttttcgggaaatgcaattcccaggtgctacggcctcatggatatgcaggttctggaggagaccggggcggcccaggtgcagcggtcggggctggatcttacgggacagggagtcctggcagcagtcatagatacagggatcgactataccaatactgtgttccagctgggaaatcagactacaaagattcaatatatgtgggatcagacgatacagggagaagatcctccaatgccttatggatatgggacagaatatacaaaagagcagattgatgaggcgttgcaggcagaagatcccctggagattgttccgagccaggatacgtcggggcatgggacatttcttgcaggcatgatcgcgggaaatgaagtacaggaagagaatttttcagggatcgcaccagggtccgagctggtggtggtaaaactgaaacaggcaaaaagctacctgaaagaatattactgtattgacccttcaaaggaagtatatgcagaatcagatatcatgctggcgatccgctatgttctggagaaggcagatgaacttaatatgccggttgtgatctatctgggacttgggaccaatctttcttcccacaccggaacttcaccgctggccaggcagatttcagccctggcataccagccgggaattgcgatcgttgtgaccgggggaaatgaagggcaggccaaacatcactatgcgggtactctctcagatggagaggttgtggtggaaataaaggtgggaccgggggaatatggatttacggcggaactgtggggctttcagccaaaccagttttttgtggacatcgaatcgccctccggccagagaaccggtgtaatatcaggaggctacaagggcagaagaaatatcacatttctgctggaacagacgagtctcatcgtagattattttaccattgacatatccactggttcgccttttatccgcatgagattccgtgccccggcagagggaatatggaaggttcatgtcacagacgaaaatgtagggagcagggagtttgacatgtggcttcccatacggaattttatcaccgatgagacttattttttggaatccacaccgtataatacactgactgcaccgggaaacgcggcaccggtcattactccttccacttataatcagagcaataacagtttttttatcgaaagcggaaggggatatcccaggaccatgaccatacagccagatttttcggcgccgggtgtcaatgtgatcggagtccttccaaggaacaggtttgggatgaagacgggcgccagtatttcaggggcagtggtcgcgggtcttgcggcactgctgttggagtggggtcaggtcaaagaaaatgacttgatcatgaacacgctgagactgaaaaattatctgatccgcggagccaggagagatccggaccgaaattatccaaacagggaatggggatttggggccgtggatgtttatcaggcttttttaagaatccgttagagacggcactacaaaagaaactccatgtttgcagacttatttccagttttttgcatcttgtttcgggaataattaatttatagtaacaagcagaatacacaggagtagtaggatgtagagagataatatttatgaaaagctgtgcccttatgtagagagggcaaaaggcggagacgaacaggccttcgagtatctctatcaccattgaacagagagctggtccttcaatgtgaatctgcagttgagcgcaatcatcgctgtgacagtaattgcggcactttaacagcaagaggaaataaatcattatatcatgcgggagccataggaaattcggcaagaaactgccgaacggaaggggagacaggatttataaatattcccggtaatctccgcggctaaattccaggtgataaccgatgctttccatcctgcgtccgagacagcctacgcattcggcggcctcatctccagtgcagatcttgttgtcgtagagagcataatctttcctgacatcaatcggggagagattcggcataaccacatttgcaccggccaggattcctttttcacggccgttcggatcaattgttccaagtgccgtggtggaaggcagcaggagatggtgattcatcaggcgcaggatgctgatcatataagttgtgaggtccgctgtgccggacggctcgtccttaaacggtgtatcgtgatgagggatgaacggcccgatccctaccattttaggattcagctctttgataaacagaagatcttcagccagatgggcagtcgtctgtccgggggcacctaccataaagccggtaccgacatgaaagccggctttttttaagtcccacaggcactgcttgcggcgggccagtgacatcgcttcgggatgaagtttttgatagtgctcctcggtggctgtctcatggcgcaggagataacggttggctcccgcctcaaagagagcctggtagctttccggtgagcgttccccaagggacagggtgatagcgcagtctggataggatttgcgcatggcggagacaatagagaccatacgctcatcatgaaaataagggtcttcacctccctgaaggacaaaacttcggtatccaagctcatatccgctttcacatgcggagagaatctgctcctcagtcaaacggtaacggctgacatttgggttggaacggcggataccgcagtataagcagtcatttttgcagtagttggtaaattcaatgagcccccttgggaaaactccggtgccatatattttctgagcttctttccgggccagggatgcaagatattcggcatcctctgctgtcctgtgttcaatcaggcgtataaaatcttcttttgacaaaatctgttctttatataatcggttgatcaactcaaaatgattcatgaagatcaggttcctttcttagcatattcgtgaaaatatcataccataatagaaatagaatagaaaggatttctatgtgggcctgtttgtgataaaatttttatcagaaactacagaagatacagaaaggaaactgttatgaacgaaaatgtaactgtttttagccatccgttaatcaaacataagatttcccagttaagggatgaaacgtgcaagaccaaggaattcagggcactggtggaagaaatttctatgctcatgggttatgaggtgctcagggatctggagatggaagaaatcgagatcaagacaccgatggagacaaccacggcaccgattattaaaggaaagaagcttgctctggtcccgattctcagggcaggactcggcatgaccggagggattctgtccctggtgccgtctgctaaagtaggacatgtgggtatgtacagagacgaagagactctggaacccaaagaatattactgcaaactgccggaagggatcgaccagcgcatgatcctgatcgtagatcccatgctggcaaccggaggatctgcggatgcggcggttcagtttgtgaaaaaaaagggcggaaagcagataaagtttgtctccatcatagcagcgcctgaaggagtaaaacgcctgtcggaggcacatcctgacattcagatctactgtggggagatagacaggggattaaatgaaaacggatacattctgccgggactcggcgatgccggcgatcgtattttcggaacgaaataaagaatgaatgagggaattacattgggaaacaatgagagtaatatttgaatcttatatctgaatgtgctaaactacaaaagttgacgttttttaaaggaaagtgagtaaaagatggtaagagaagatattagaaatattgcgattattgcccatgtagatcatggaaagaccacattggtggatgagttattaaaacagagcggtatcttccgtgaaaatcaggaagtagaagaaagagtcatggactctaacgatattgagagggaacgcggtatcacgattttgtcaaagaataccggcgtgcgctataacgatgtaaagatcaatattattgatactccgggacatgctgacttcggcggcgaagtagagcgtgtgttaaagatggtaaacggagtggttcttgtagtagacgcctttgaaggccctatgccacagacaaagtttgtattaaaaaaagcgctggaattggacttgtctgtgatcgtctgtgtcaataaagtagaccgtccggaagcaaggcctgatgaagtggtggatgaagtactggaattactgatggaactggacgcagacgacaagcagctggactgtccgtttgtcttcgcgtccgcaaagggcggatatgcggttgccgatctttccgatgagaagaaagatatgaagccgctgttcgacactatcattgaacacattgaggcgccggagggagatccggagaaaccgactcaggtattgatcagtaccattgactacaatgaatatgtgggaaggatcggagtcggcaaagtggacaatggttctatcaaggtaaaccaggagtatatggttgtaaatgcccatgaagaagagaaacagcaaaaggtccgcatcaccaagttatatgaattcgagggtcttaacaaagtggatgtgaaagaggcaggcatcggttctattgttgccatttccggaatttcagacattcatatcggggatacgatctgtgacatggatgagccggctgcgatcccgttccagaaaatctcagagcctacgattgctatgcagttcatggtcaatgacagtcctttggccggacaggaaggaaagtttgtcaccagcaggcatttaagggacaggctgttccgtgaattgaatacggatgtcagtttaagggtagaggaaagcgataccacagacagttataaagtatccggccgtggagagctccatttatccgttctgatcgagaacatgcgccgtgagggttatgagtttgcagtgagtaaagcggaagtcctctataaggaagatgagaaaggcaaaaagctggaaccgatggagatcgccgtagttgacgtgccggaagagtttgccggagccgtcatcgataaattaagccagagaaagggtgaacttcagggtatgagttctgccaaaggcggttattcaaggcttgaattctctattccgtccagaggtttgatcggataccggggagaatttttgacagataccaagggaaacggcattttaaatacagtattcgacggttatggaccttataagggagatattcaataccgcaagcagggttccctgatcgcgtatgaaacaggggagactgtgacctacggattatttgcggcccaggagagaggaacgctgttcgtgggagccggagagaaggtttacagcggcatggtcatcgggcagaacggaaaagccgaggacgttgaggtgaacgtgtgcagaacgaaaaagctcaccaatacccgtgcatcgggttccgacgatgctttaaagctttcgccgccgaaaattttaagcctggagcaggccttagagtttatcgacaccgatgaactcctggagatcactccggaaaatatcagaatccgaaaaaaaattctggaccctacgatgagaaaaagacaggcgtataagaaacaataatgtcaaaaccttccgaatattttgtcgaaggatttttcttctaattgttgtcagtttagaatactctgtatagtacacgaattgatacaagaagggagaaaaagtatgacagaaaaaggaatcaataataatcaagtggaggtagcgggcgagattatatccacctttgaatacagccatgagatttttggcgaaggtttttatatggtcaaacttttagtaaacaggttaagcgaagcgactgatgaaataccattgatgatttccgaacgtttagtggacgttacaaaggactgccggggcaaatatctcagggctttcggtcagttccggtcgtataacaaacatgaagaaaaccataaccatttgattttatccgtcttcgtaagggatttggaattcctagattccatggaagacgtgaagccgaaccagatccagctggacgggtttatatgtaagcagccggtttaccggatgacacccctcggaagagagatctgtgacatcctgctggctgtgaaccgttcttacgggaaatccgattatatcccttgtatctgttggggaaggaatgccagatttgcggggagtttagaaatcggcgccaggattgaacttgtgggaaggattcagagccgtgagtaccagaagcggatcagtgaatttgaagtcgtaaagaggactgcatatgaagtttctgtgaacaaactggaaatgaaggtcccggaagaagagtaaaactccctgttttacaggacatgacagggaaatcagcgcgatagataaagtatggattttttgccggaatggtgatataataaagcgatattactaaaggaagattctttgaggtgaaaagatgaaaggacgagtggaagtttactgcggccagggcaaagggaagacatcgtcggccttaggccactgcatcaaagcagcaggacaggggaagcaagtcattattgttcaattcctgaaaggaaaagacacggaggagatcagctttataagacgcctggaaccagagattcagctgttcagttttgagaagtatgaacagcactatatggatctgacacctgaacagaagaaagagcaggagcatttcatcggcaacggcctctgttatacgaagaaggtcattgacaccagacagtgcgatgtcttagtgcttgatgaggtactcggacttttagatcttggacttctttctgaggaggaactggtagccctggtctccggaagggacgaggaactggaagtcattatgacaggaagaagactgcctgattctttgaaggactgggtggatgacatctactgcattaacacaattaaagaatcataagattacataagagattaggaggaatgtatatggctatatttaccggagccggcgttgcattgatcacgccgatgaaagaagacttatcagtagactatgaccagcttgagagggtcattgacgatcagattaatcacggcaccgacagcatcatcatctgcgggaccacaggggaagcttctacgatgtctcacaaggagcagatcgaggtcgttgccgcatgtgtttcctgtgtcaacaaacgggttccggtcattgccggggcaggtgctaattgcacagacgaagccctttatctcgccagggagtcggagagagtcggaagcgacgggcttttagttgtaactccatactataacaaagccacacaggcaggattggtcgagtattacacgagcataggtaattctgtaaacattcctatcattatgtataatatcccgggaaggaccggagtgaacattcagcctgagacgacggcaaagatcttcaaatcagtggagaacattgtaggtatgaaggaagccagcggcaatctttcacaggttgcggatgccctctatctgacagacggagaacttgacatgtattccggaaatgacgaccagatccttccggtcttatctctcggaggtaagggtgtgatctctgttttgtccaacatcgcaccgcaggagacccatgatatggtcatgaagttcttaaacggagacgtaaagggcagccaggaacttcagatgaagtatatggacgtgatccataaactgttctgtgaagtaaacccaatccctgtaaaaagagctatggcagagctgggattcggagccaacgcagtgagaaggcctctcacagagatggaagaagatcacgcacaggaactcatcgaatctatgaaaaatgtaggaattctttaaggagcggcacaaatgataaaagtaatgatgcacggctgcaacggtgctatgggacaggtgatcagcgggatcatcgaagaatccgaaagtgcggtcatggcggcgggaatagactttaaagacgacggacacaatccgtatccggtatttaaaaatctggaagactgcaatgtggatgtcgatgtaatcattgatttttcctcatccaaagccacggaccggctgttaagctatgtggctgaaaagcagataccgcttgtcttatgtacgacgggtctgagtgaagaacagttaaaaaaagtcgaggagacaagcaaaaagaccgcaattttaaggtctgccaacatgtctcttggggttaatgttttattaaagcttgtgaatacggcagcaaaggtgctggcagatgcggattttgatattgatatcgtagagaagcaccataaactgaaagtagacgcaccgtcaggaactgcccttgcgctggcagacgcagtcaatgaagcgcttcacaacgagtatgagtatgtttatgaccgaagccagagaaggatcaggcgtccgaaaaaagagatcggcatttcggcggtccgcggagggaccatagtcggacagcacgatgtgatctttgccggacaggatgaagtcattgaatttcatcacacggcctactccaaagcaatctttggaaaaggggcagtcagcgcggctatctacctggcgggcaaaccggccggcatgtatgatatgagcgacgtgatcggttaaatattgtttgaaaccaaaggcggtacggctgatgatgcgtactgcctttttgtgaacatacgaaagaaagagtgggatttatgttatcaaaaaaagtattagagttatcgaagcagcactccgtgatccgggatatttttgaattcggcatggagagggcaaaagaagtaggagctgaaaacgtattcgatttcagcataggaaacccatcggttcctgccccgaaggaagtggatgagacggccatgaagtacatagagagcggcgatccggtggcagtccatggatatacaagcaatgcgggcatatttgaggtaagggatgcagtggcaaagtcactgaacaaaaggtttgacacggcttacagcgcggataatattttcatgacgattggcgctgcggcggctgtgggcatttgttttaaaagtctggtggacgggccggaggatgagatcatcacctttgcgccttatttccccgaataccaggtatatgccgagggagccggatgtaagcttaccgtgattccggctgagactgagacattccagattgattttgaaaggcttaagtctgccatcaatgtgcacaccaaggctgtgctgatcaattctccgaacaatccttccggagccgtttattccagggagacgattcagaggcttgcggagcttctcacagagaagcagaaagagacaggccacagcatttatatcatatccgacgaaccatacagggagatcgtctatgacggaatagaacttccccacgttccgaaatattatgacaacacattagtctgttattctttcagcaaatccctttctattcccggagagaggatcggctatatcatcgcaccgtgtgaggcggaagattatgcggatcttctgcccgtgtttatcgcttcaggaaggctgctttcttatgtgagtgtgcccgctttatatcagaaggtagtcggcgactgtgctgatctcacggcagacctgtccgtatatcaggcaaacaaagacttattttataatgccttgacggatatgggctacgagtgtgtggagccgggaggggcattttacctgttccccaaggctttggaaccggacgccaacgcattttgtgagcgggcaaagaagtatgacctgctgatggttccgggggacagctttggatgtccgggttatgtacggatttcctactgtgtacctacggaaaggattgagaaggcgctgcccctgtttcagaaactgatcgatgaatacaaggagaattaaaatgaaatcttggagagataatataagaaatgtagtcccgtataccccgggagaacagccgaaagaggacggtgtgatcaagctgaataccaatgagaatccatatcctccttctccgaaagttttagaagcgatgaaccatattaaacatctgagaaaatatccggacccggcagcggcggatctcacagaagcgatcagttcctactacggtctgaatcgggacgaagtcttcgtcggagtcggctcagatgacgttttagccatcgcttttctgacattttttaattccggaaagccggtgtttttcccggacattacctattctttttatgatgtctgggccggcctgtttcagatcccgtatgagaccaaagcattggatgaagagttcggcatacatgccggagattattacggagaaaacgggggagtgatctttccgaatcccaatgcgccgacaggggctcttttagaattggagacagtcagggatattttagatcataacagagatgttcttgtgatcgtggacgaggcttacatcgactttgggggtgagagcgcgagaagccttatccctgaatatgataatctgctggtcgtacagacatactctaaatcccgctctcttgctgggctcaggataggatatgccatgggaaataaagagctgatcaaggctatgaacgatgtgaagtattcctttaattcttacacgatgaacgagccggccattgttatggggaaggcggcgatcgaggatgaaaaatatttccaaaagacaagagaaaagattataaataccagagaatggtttcaggaggaacttagaaatctgggatttgcatttgcggattccaaggcaaattttgtctttgcatcacacgaatctattccggccaaagaattattcgaagcagcaaagagagaaaaaatatatgtccggtattttgacaagcccagaattgacaattatttaagaattacgatcggcacagatgatgagatgcagactctggtgaagtttttgaaaaaacaaataaggccataggataaagcaggcaggtcacggaaaatttcccggtactgcttgcttttttaaaaactttgagttaagataataatgtaattatttctaaaatatggaatatacggggaggggtatgacgtagacttccgtttcagcaaggaaggagacggttatgttgaccagaccagagtttttaacttatgtagaagaacacatactggagtatgtgaaggacccggaggaaaagcaggcctccatccggcaggtgacaaagaacaataacatcagtttaaacggcctctgtatcggaaaaggagaagaagtctgccagcctatcatttatttagattcctattatgaggactaccgggagggagcagacctgggagagatcctatgcaggataggtgcggtctatgaggacagcagggcagacagtccgatcgatgcttccctttacagggattacagccacatgagggatctgctgtttttccgtcttgtaaattatgagaagaacaaagaacagttaaaggactgtccctgtgagagaatcgaggatctggccgtgacttaccggtggtttgcccaccatgacaagaatgggatggccagtgctctgatccgcaatcaggatcttgacttatggggcatcacaaaggatcagctcatgaaagatgcaaaagcaaatacaaagagagtttttccgcccctgctccggcctatggaggagttatttcctcagatggatgcggcaggagagctgtttgtcctgaccaatgaagagggactcaatggtgcgggaactgtcctctatgaaggaattctcgacagtttttccgatcagattaaaggtggattttatattcttcccagcagtatccatgaggttctgcttgtgcctgaaaaggaaggaagtgatcctgcggccctctcggaactggtgaaagaagtaaaccgtaccgtggtggatgacggtgagatattgtctgaccggatttactattatgaaaaagggcagaatgtatttatgtcgaaagtgtgaattttacatccggagggactgtgaccttgtcatccggagaacgttactttataatgtaaataattaaaaagctggggtgatgaaagatgagacgttgggaaatatatctggaaatattcatggaacttatagtgatcgcgggaggggcctttcttctgatctttgtcctgcctaagtgcatcggattcttatggccctttgtggctgcttggattgtggcgatgctggcccatccggtgattgcgtttttggaagacaagatcagtcttccgaagagattcggctcggcactgatcattattgcggtgattgcaggcctgatcgcactgatctcatttattgtcagccagctggccgcccagatcgtgggctttgcggccaatcttccggatctgagggagacggtccagacacagctgatgaatctgaaagaacaggcagtgcaccttctggattctctgccatatggaatgggagtaaagtttgatacgatgctcggttccacggacaaggtgctggacaaggcagtgagtgccatcgggaattacggcatggaacattccggcaatgtggccaaaggcatgaccagcggatttatcggaacggtggttatgttctttgcctcatatttgtttatcgtggataaggataagattgtgcagggatatgaaaagcacgttccaaagatggtccgtcataagatcggtatcttttaccacaatacactgggagttttggcaagctactgctgggcacaggtaaagatcatggtcatcatagttgcgattctctggatcggctttatccttgcggggatcagctatgcatttttcctggccgttgtgatcgcgattcttgatgtgctgccgattcttgggaccgggacggcgatcatcccttgggcactctacaagatcctcacaggagatattaagaccgccattatactgctgatcatctatgtgatctgtcttgtgaccaaacaggtgcttcagcctaagatgatgggagacagtatggggatttcaccccttgccactttgtttttgatttatatcggcttaaagctctcgggcattggaggcatgcttcttgctttaattctgggtatctttgtgtataatctatataagctggggatctttgaccggaagattgcattcttccagcgaaggatcgagatgctgacgataaacagtgagaaggaagaagaacagataaaagaagaacttgacagaagagaaagagagggaaaagaatcatgagttacgcagatactctgttcatcaacatgtgcagagatattttagaaaatggaaccagcacagagggagaaaaggtcaggcccaaatggccggacggcacaccggcttatacgatcaagcagtttggcgttgtgaaccgttatgacctgtcaaaggagtttccggcgctgacactgaggaagacatttgtcaagtctgctgtagacgaactgctctggatctggcagaggaagtcaaacaatatccatgatttaaagagtcatgtgtgggatgaatgggcagacgaagacggatccatcggtaaggcatacggctatcagatgagggtaaagcatcagtatgcggaaggcatgatggatcaggtagacagggtgatctacgacttaaagaacaatccatacagccgcaggatcatgacgaatatttacgttcatcaggacctgcatgagatgaacctttatccgtgtgcttacagcatgacatttaacgtgaccaagaaaccgggccatgaaaagcttgttctgaacggcatcctaaatcaaagatctcaggacattctggcggcgaataactggaacgtagtccagtactcggttctgctctatatgctggcacaggtatgcggcatggagccgggagagtttgtccatgtgatcgctgacgcacatatctacgaccggcacattccgatcatagaggaactgattaagcgcccggtttatgatgcaccgaagttttccatgaatcccgatgtgaaagacttttatgagtttactctggatgactttaagatagaagattacaaagcaggggagcagattaaggatatccccattgccatataggagagaaatatgaatttgattgtgaatgcggacaaaaactgggggatcggcagggaaaaccagcttttggttcatatcccaaatgacatgaagatgttccggcagacgacgacaggaaaagtcgtagtgatgggaagaaagacattggagagttttccaaacggcatgcctcttccaaaaaggacgaacatcgtcctgacgacagatcaggactacgacggccggggagccattgtggtccacagcgaggacgaactgtttgaagaacttaaacaatatgcggatgaagacatctttatcatcgggggcgagagtatataccggatgatgcttccttactgtgatacggcctatgttaccagactcgactatgcctatgatgcagacacatattttccggatcttgacgcacgaaaagagtgggagattgtaaaagaaagtgaagaacagacttattttgaccttgaatatgtatttttgaagtatcagagacggaatgacgattgacagaagattcaaaaagtttcataataaaacttaatgaaaaactacatataacaggaaggaagagataacatgttagatatcaaagttgaaaagacacagtgtccgaaagaaaaaccgggaaaagatgatccgcttctgtttgggaccatttttacagatcacatgtttgtgatggactatgatgaggaaaagggatggtatgatccgcgcatcgttccctatgctgatctcacattgtctccggctgcaacgatctttcattacggacagggtgtttttgaagggctgaaggcatataattcagaaaacggaaacgtgaatttattccgcccggacatgaacgcaaagagatctaaccgttcatctgacaggctgtgtattccggaaatcccggaagaagactacatccaggcgattgagcagttagttgcgctggacaaggactggattccgagtgaaccggaccattctttatacatccgtccgtttattatcggtacagatccgtttttgggcctgaagacttccagatactatcagttcattatcattctgtcaccggtaggaccttactatccggaaggactggaccctgtcagcatctggatcgaagatgactacgtaagagctgtacgcggaggaatcggagaagccaagaccgggggcaattatgcggccagcattttatcccaggtgaaagcacatgatgaaggatattcccaggtactctggctggacggagtggaaagaaagtatatagaagaagtaggagctatgaacatcttcttcaagatcggcggcaaggtagtgactccgaaactaaacggaagtattctgccgggtattaccagagattcagtaatacaactctgcaaagagtggggatatgaggtagaagaaaagcggatttccatagatgagatctatgaagcccacaaagcaggaattttggaagaagtttggggaaccggaaccgcggccgtcatctcaccggttggcaaactgcgctggggagatgagatcatgcaggtaaaagacggaggaatcggcgaattaagccacaaactctatgacactgtgagcggaatccagctgggcaaaatcgaagatacccatggatggattgtggaaatcaaataaatgttacgtctggaagaggagcctctcttccagtctttttttaattgaaatattgtattcttgaaatgactttggtataatattaaaacgtgactaaaagtcataaactcaaattcatatattatgaggaaatgaaaggagattggacaatggaaatgtacattgcgattgcagccggaatcttatctctggttgttgcatttgcactgatgacgaaagtaaaaggtgcggatgaaggaaatgaccagatgaaagaaatcgccggagcgatcaacgaaggagcccatgcatttctaagggcagaatacaagctgcttgtagtattttgtattgtagtatttgtattgatcggccttggaattcagagctgggtatcagcagtatgctttttagtgggagcatgtttttctgctcttgcaggatttatcgggatgcatacagcaacaaaagcaaacgtaaggactgcagaggcagcaagatcaggcgggatgagcaaagctttatccatcgcattttccggcggtgccgttatgggacttactgtggtaggtcttggactgttcggtgttactatggtttacaaggtgactggagatgtcagcgtactgacaggattcagtttgggagcatcctctgtggcattgttcggccgtgtaggcggcggtatttatacaaaagccgctgacgtcggagctgaccttgtaggtaaagtagaagcaggtatcccggaagatgatccgagaaacccggcagttatcgctgacaacgtaggtgacaacgtaggtgacgtagcaggaatgggtgccgacttatatgaatcttatgtcggatctatcgtatctgccattaccatcggtgttgtagcgttcagcgtaaaaggtgccgtttatccgctggtactcgcagcgattggtattgcagcatcaatcctcggtgttatttttgtagtaaatacgaagagtcagaatccgcacagggcactggacggaggtacatacttctcaagtgtcatcgttttgattgcggcattcttcttaagccgtcagttcttcggaaacctggatactttctgggcaatccttggcggtgtcctggttggtaatattatcggtaaattaactgagttctacacatccagtgactacggcgcagttaagaagatcgctgatcagtctgagacaggatctgcgacaacgattatttcaggacttgcagtgggaatggaatccacagcattcccgatcatcttcatcagtatcgcggttatcgttgcatatcagtttgcaggtttatatggaatcgctctcgcggcggtaggtatgctttccacaacaggtattaccgtagcagtcgatgcttacggaccgattgcggataatgccggcggtatcgcagagatggctgagttagacgaatctgtgcgtaagattacagataaacttgatgcagtaggtaatacaacagcggctatgggtaaaggattcgccatcggttcagcagcattaaccgcattggctctgttctctgcttattcacaggctgttgacctgacaacaatcaactgtctggatccgaaagttatcgtaggtgtgctgatcggaggaatgcttccgttcttgttctcagcgttcaccatgcagtctgttggtaagacagcaaacgaaatgatcgtggaagtacgccgtcagttcaaagagattccgggaatcctcgaaggaaaaggaaaaccggactataagaactgtgttgagatttctacatcagcagcattaaaagaaatgcttcttccgggtgttatggcaatcattgccccgttgatcatcggtgttctcttaggagtggaagctctcggaggattattagtaggatctttggcatctggagttatgatggcgatcttcatggcaaatgccggaggagcctgggataatgcgaagaagtatattgaagaaggacatcacggaggaaaaggcagcgatgcccataaagcagccgttgtcggtgacactgtaggtgatcctttcaaagatacatcaggaccgtcaatcaacattttgatcaagttaatgacgatcgtagctttagtattcgcaccgttattcttaagtatcggcggaattttataagaaatgaattaaaatccatggaatcgaaaggttccatggatttttttgtcctaatacaggtttcgttggaattcagttttctgcggccgctgcactgcaggtatgagaatcagatgtttttttcatcatgagaacagcgatgaaggtcactgtacattctgctgcgataattccggtccagagggcctgcctgccaaagactgcaggcatgagaaagataaatgcgacatttatgatgaaacttctcagtgaggctatcgtcagggctttgaatgtccttttggacgccagatggtaagtagtaaagatcatattgactgccgcaaacaaaaaggagactccgtagacagataaactctcaccggcaagctttaccagcgccggttcccggttaaagatgtgaatgaccggttctccaaacaagagcagtacggcatacaggaggaaagcaagaagaaagtttacggcgataccttttttgaggaagcagcgttccagttctttctttccctctccggcggaacggctgatcaacggctgtatcccgtcagaaacgccgataaatacggagaagaccagtgttaaaagataacatactacggaaaaagcagataccccgatgtttccaagataacgtatgacgatcagattatagcagaagatggtgaccggctggctcatctgagtgatcagttccggtatcccccgtctcaggatctctgaagtgtaatattgttctataggaagaagctttagcttcagccttcctttcccatgaataaaatgaggaagcataatcatacaggaaattacctgcccgagaccggaagcgacggccgctccgtggattcccatatgaaagacaaagataaacagccagtcgagaaagacattgctcaaagctccggccgccataccggccagtcccagtttcgggtttccgtcattccgcacaaacgctgctagtaccatagccatgcagaagaagattccgaataaaatatagtaccggagataatcggatgtaagagatagaagatctccgcgtgcccctaagagcctggcaatctggtctgaaaacaaaaagctgaacactgtcataaaagctgaaaatatcaacaccagataaatgctgttcataaatgagcgcagagctttttgttcatttccctgaccaatgaagatggatgtaatggttgatcctcccatagcgatcatcatggcaactgcagtcaaaatacatataaagggaactgctaaattaatggcgccaagaccgtttgaaccgaccccgcggcctacaaagataccatcaaccacaaaatacaatccggttaccatagatgcacagactgacggtatcacaaactgataaaatttatgtttgttcattataaaataacctccaaatttttgttataataaaagtataaagtatcccatcatgggagagtcaaggaggaattaaatgaaagaatatttgacaatcggggaagtctccaagatgaaaggagtcggcattaaatctctgagatattatgaccgcctcggtatactaaagcctgcatatataaatcccgataccggttaccgatattattcaattgagcagatgctcatgcttgatatgatcctgctgtgccttgggctggacattccattgaaacagatgcaggagtatatggatgaagagggtcatttagatatgaaaggactgctgaaagacggaaggaaaaaagcagaggaaaaagccaaaaggatacaggacacactgttccagatagacgggctggaacggcggatcaggggagccgaggaaatacggaataagggcagtgacagttacagcaaatatattggggagagaatggtcatagcgctgccttggaatcacccgtccacggatgataaagcgtatatgagtgaagtgacaaaattatattcgctgtcccaaaagttggagctgacggttttttatcagcagggtatcatacatcatagaaaagggggagaagccaaatcttatatcttcctggagatacagcagacagatgtaaaagatcccgggattttcagtctgccggagggaacttatgagtgcagcgtatctgaggacaccagaatcgatgaaaaggcagagacaaaaaaccagccagaagatctattaatagtagaaacagacttttatttcggaaaacagccaaaagacagatacttcttagaactgcagatatacaaaggaaaagacggtgggaaataaaaatccaccgcctttatgaatggatgttatttttgccggataagtgtcctttgaacaaaaggagccagccagcgattgttttttatcactattggaggaacgcattttaaagcgtgacggaaatagtgagaaaaaactcaagggttaagttccgcaatccggcttacagccacataaatctcgctgattttataccaggtcggataatctacgactccggtctgcccaaggccgaatacattttggaatactcttaccgcatcggccgtctgctgtccgtatgtgccgtccaccggtatcgtagggatagaaggatagtccttcgcaatccggtttaattgttcctgcatctgacggactttatcaccggtggagcctatggtcagatcataacccggccaggaggaaggaatgcctgaaatctgctccgcggtattgatatacatactttctccatagtaatatctgaggatttcgataggagtatatccctgatctcccagatatttagatccccactgtgtcatccactccggacagcttacccgtttgccgtcacagtattgtgtcaggatcggctggcgtacgttcggccgggacagatagctggcaaagatttcatctacaatcgtattgatggaatcatatgttgtctttccattgatccacttatgatcatatgcagtggaggaagtaatcgtaaagtcgtgtcctttgtttctgtaccactcagtgtaaactctgttgagagtaaaggacatgattgccaaaatgttggcttccagggtcgaacgaggccatgttgagtaaacttcacaggcagccacattcttaatgtagtctttatagcgcacataatagttttgggcagtctggtcagtaatagctccgtcgtggacaatgacgaattcgggaatcactacccggctaagtacgatctcaccggattcattgactggcttgatctcatcttctgcaattttaggaggataatccccccagagagtatgagggcctataactatattatcgagtgttgtagatgcagtttccaggggaaccatggaaacattttggagaccatttgtatctgccagaatctgagctcccgagatcgttaccggctcatagtcgggcgccgtcacatgcagattatattctgagtatggctgattttcactcggggaaaggctgtattccaccggcggagcatcaagtgctacctcttcggtctgtccgttctgatcagtggttacttcctcgagaacctgatcggattctccggtataggagatagatatagtagcattccgcaccggaacatatccaatggtagagtttacttgaatttttaagtttcctttgtctgccatttaaaaaatcctttttcttttactatatgccggtgtgataaaaatataaccagagtcacttctgatgtgtgtttcctagatttaagaaatatgataacattagaaaagaataggaagcaaaaagagaaagaggtaatcatggataatcaggaagaaaaacaaaagcacaagagacgtatccggtacagcgggacccatcccagaaattataaagaaaagtataaggaacttcatccggaccaatatccggatacggttgcaaaagtcattcaaaaaggcagtacgcctgccggcatgcatatttctatctgcgtaaaagaaatccttgagttccttcagattaaaccgggacagaccggtctggatgcgactctgggatatggaggtcatacgcaggagatgttgaaatgtcttgactcaaaaggacatttgtatgctctggatgtggatgccatagaacttgagaaaacaagaaaacgtcttgaaaagctcggatatgggccggaaattttaacgatccggcagatgaattttgcggatatcgacaaaatagcggaagaagcaggaccgtttgactttgttctggcagatttaggggtctcatccatgcagattgacaatccggacagagggttttcttataagacagaggggccgctggatctgcgcctaaaccccgaaaaaggagtctctgccgcggaaaggctcagaaccatcacaagacaggagttacaggggatgctgatggaaaattctgatgagcctcatgctgacgtgatcgcccgtgccgttgtctctaagataaaaaagggaacagccatcgatacgactacaaaactccgggaagtgatcgaagaggctctggaatttctgccggagcatgagaagaaggaagctgtgaagaaaacgtgccagagaacattccaggctttgcgcattgacgtaaacagtgagtttgaagtcctgtatgaatttttagaaaaactgcccaatgtactggcaaaaggcggccgggcagccatcttgacctttcactccggggaagacaggctggttaaaaaatcgtttaagcgtctgctgcgggagggtgtctatcaggagatatcaaccgatgtgatccgtccgtcggcagaagaatgcaggatgaacagccgggcacggtcgacaaagatgagatgggctataaaagaatgagttattcaccactatttccgtcgcgcttttgaaatgcgctcctccaatagcggtaaataactttcgaaaagtggcaccttttttgacagaggcccttctccaacagacattacgtccattttccacatgattggagtgatgcattctaagagccgaacggaaatcatgtggaaaatgtcatagtttaatcagtcaggaggttgatgagatgatttatgaagaaaaagaactggaaatggaaggtgtgcttcagacagccagacagatgtgtacggctgccagaaccgcaccgaaagcaagaggactggattttatccacactgcggtagtgacagggaaggatctgaagaatcttgccgatgagacagagcgtcttggaaaagaacaaggtcaggatttctatgtgagagatgcagataatctccgcaaaagccaggcggtggttttgattggggtgacttatcagcaaagagggctgaatgagtgctgtggttggtgtaatcagacaaactgccagggctgcagggagaaccaaagcgtctgtgtatttgatccggtggatctgggaatcgcactgggatcggcagttagtgtggcatccttaaaccatgtggacaaccggatcatgttttctgttggaaaaggagcactatccttggggatgctgggaccggaagtgaagataatccttggaattccattggctgcggcgggaaaagcgccatattttgaccgaaaataacgatgttttcccaaccggctaaatttaaaaagtggtccaaaacgttgattttacaggggttgcagaggatttttaggattagttttgaaaatggacggccggttgggaaaaaagctggaaaacgttgaatatatctaggtttagagatataatggaaattgaagaatggcttaaatacgttggataaataaaaacaagagttgtattgaaatactgcttttccattccattctgtcatgatacgccctgataaataaaaacaagagttgtattgaaattacactagtctgcagtgataactatccagcgatcacgataaacaaaaacaagagttgtattgaaatgggtttttagaagatcttgcaaaagatcttgtaaagataaacaaaaacaagagttgtattgaaatttattatcaaacgcccccagccagtacattctccctgataaacaaaaacaagagttgtattgaaatcacatgaatttcggtcgtgcacataaattgcggcaccgatacacaaaaacaagagttgtattgaaattgatgaattactacacctccaataatacttgattccgataaacaaaaacaagagttgtattgaaatacacttacctcctcttttgtcaaaggacgtccacagataaataaaaataaaatgaataatagattgcttatcttaatttgaattgtttgaaagtactatgaaatgttgtattattttgaaaaatatagtaaaatagaacaatagagtggtttgtgtataaaagctactaatgaatcattccctccagggcaatcgttacgataggtactatcagcatgtatacgatacgagggtgcatacaaaagaaaggggtggggcagtggatttgaaagtttttgaaattcggctaaaagtatatctgttagaagatataccggtagaagcagttcaaaagaagacagccgcactaattgacatttgtctgagcagagacgaagcacttctgaaatttcatgagacgaatcaatttaagaattattctttcggaaatccatatccattggaaaaggacaaaatttataaaaaggataaggtgtatgtcataacaatccgcaccattgatccacagcttgcaaaagtattttccgaaaaattaattcatgagcgatccgatgagatgcaggcattaacctgcgaaatcaaaattatccccaaagaaaataaaattattgatacgatttattctatctctccggtgattgtgaaagcagaacgctactggaggggtgttttttctttacaggaatatgagaaaagactgactgtaaaccttgttaaaaaatataatgcgttctgtgatacaaagatcaatgaagattttgaattcattcgtatgatcgaggtcaaaaacagaacgccgatcactgtatcctataagaaaataaaacttttaggagataaaatcgcgttaaaggtagcagataatgaattgtcacaggaattaagctatatgacgctgggaacaggactgggagaaatcaatgcgcggggggctggttttgtaaattacaggtggatgtaggaggtggcattttgcttagagagtgtacggaaatattcagggaacaattacagcaaaacagaaatctgctgttcgactcttacataccggccaacggaacctatctgattgtgaaggaggacggaagcttatgtgagcctgtggagcttgagctggataaaaaaagcggccagataaaccgcaccaaccgttatttcactcaaatctgccagtatgactattacagcaggctgatcgatatgaataaaccgcaggacaataaaaagatcattcattccaatagttatctttcattttttgtaaagaaagagagttttcaaaatggaaaactgaacacggaagctattgaccgttacttcgatgcagtcatttatccggagcttaaatataagggacagacattaaagatttatcaaatgctggaagaagaaatcggatgtgttccaaaggatatcgcagaaaagatccgcatgtggataaaagagaatatctttcatctggatgtggatctatccaaaaaagattatctgaaaatattttttgaagcgccgatggagcagtatcaacgggaaaatgacagatatctggtgccgaatatttataacagcaatgattataatctggaggtggaaggcgaagtatacggactgccgaataacaatctcggaatgaacgcaaaaaaaccttttctgtccagccgaacgaagaaaattgaggtgccgtttctgctgaacaaagaagaagtccttcttcagaaacagttttttgatcatctgatgaactatgccatggcgggtaaatccaatgtatatatagatacggatgaaaggacgatatgtgcgttcaaaaacaatgaaatcattgaccgtgactttaagggatattatcttcggattcaaaaaggaaaagaagtagaaatccacagcagcgatattgttccatgttatcatccttctgtgaaaaaaccattcgtatatcgaaatgccctttcctatactccgaaagagcataaagaaggaacggaatatggcgcttattatacgaaagagaagatacagagtctgctggacgcagttttcttttctaaatttcttaagggcaattattttactccgcaggataaactgggaatgaacgatggatatatcaagcggaatctcatcatttccagagaagctgtttttgactggctgtacaaagatgaagaggtgcaggcagcaaaagttctgggaaacgtatctttagatttagtattgggagcgttgaaagaaggttacatttttaaggccatggactgctttaatttgcgccactcactgttggaatatttttcggataaaggagaaaatacgatggagaataaaataaatcagatagtgaccgatctaaaggcaaaactggatgcagaggaaacaccggagatacagtcagctgatgaatatttctttgcagtcggacagctggtgcagtattatatttcattaaataaaggaaaaaagaagacacatgcattggcaaatccgtttataaatgcaaaaacagatgcagtcttaaaaaagaaactggtacagtttttcttgaaatataattatgatattggagtatcaagcagacgttttaataacctttactgcatgataacagaatatgagctgaaaggggatattgagaaggatttgatgatcgcagggtatttacacagcagtttgatttatgtaccaaaggaggataagtaaatggataaaagagtatatggggttttggggatttcttcaatcatggccaactggaatgcggattttaccgggtatcccaaaactacgcaggacggaacaacctttggcagtgataaggcactgaaatatccaatgaaaaaaatgtgggacaatgaaggaaaaaaggttctttatatcaaatctatgaaattttccgaggggaaaaagggcgaagtgacattggttccaaattccctgaaagagcgttacgaacatttatatgacatagaagatctgaaaaaatgtaatgacacgaaggaagtaatcgaaaatttgtttcaggcagtagatgtaaaaaactttggagcaacatttgccgaagaaaaaaacaatatatccatcactggagccgttcagtttgggcagggattcaataaatatgaggggacaagcccggaggaacagcagatcttgtctcctttcagggacggatcaaaagatgataagaaggaagaagcgaaaaactctacactcggaacaaaaatcgtcagcaatgaggctcattatttctatccgtttgtggtgaatcctctggcatataaagagtttgtacagctgggtgtgactgacggatacacagaagaagactatgagaatttcaagcgcacagcgttagtttcagcaactgcttttgccaccaacgcaaaagaaggctgcgaaaatgagtttgctctgtttgtggagacagagccggatttatatttaccaaatctttctgaatacatcaccttcacaaagggtgaagacaaaaatgtgattgcatttaaagatacagaatttttagatgcacttgctgacaaaatcaagagtgtagaaatttactataatccatatacaaccaaattagaatgtgaaatcaagggagcaaaatactataatattattacacaaaaagaggtgtagccaatggaagtatgcaaggttactctgaaaggaaggactgcttttttcaaaaagccggatgtgaacagttattactattttacttatggccagattcataaagttgttcttctcggaatctttggagccatacttggctattcaggctatgaatccataaaaacagaaaagcggaaaaaggattctgcggaaggaccaggtttcccggagttttatgaacgtctcaaagactgcagattttccattgtgccaaagaatgagaaaggctggattccgaaaaaaatccaatactttaataattccgtcgggtatgcttccagagagcagggcggcaatctgatcataaaagagcaatggctggaatcaccggagtgggatatttttattcttctggatggtgaggagagccgtaaactttctgaagctttaatggacaggtgctgtgtttattctccttatcttgggaagaatgatcaccctgcggatcttttaaatcctgatatcatagaggcagaggaagtttcgccggaaggcagacagctggattgtctgctgccaaaaggaaaagttacatttgcatatttggatgaagatgacgatgaggaagaggatttctataagtatgaggaaggactgccatatgcattgaaccctttcacaaatctttatgtcacagagccgtttgtctatacgaaccaatatgtaaaagagtgtgaactgcccttataccgggcagggaaaaatatcattgtattttattaaaatgccgtcggagagaattctgcctatatgcaggattctttccggcggatttttacattataggggggaacagatatgtattttgataaagacgttgtaaaaatagaggatctgatcaaacaaccggagcggtattttgctcacaagccaaagaaagacgacaggaaaaaagaaacattaaaagagcacaccaacctggcagaagcttattttctgaagatttttgaggaaaagaatctgggacactgtatggaggtgtttgaagaaaaatactttgatcagctcagctgggaagcaaagaatcttttcaggagcatgatgtttggtattgtgacctttcatgatttcggaaaagtaaatccttattttcagaaggaaaagatgggtcatgaaatgccggaggctaaaaagattttttctaatagccatcactctttaatttcggctgctctttactttgaatattttatggggaaagtatgggagcttgacaagaatgataagaagcagctgaaagagttcttatttctgaattcttatttgatagcaaaacaccacagcgatctagacacatttgaaaaatatcttaaaagttttgaagatgaagatatctatcatttgattgaaatgctggaagatcaagaccatcttaatttttataaaaagccgtttcagtgttcgcttaaaagacaaagacttggaaaagccgcaagaaatttaaaaaaagcagcgcgcgatcgaaaaagccggaccaggcagattcttttttacgcgtatgaacggctggcttattctctgctggtcgccagtgaccattatgctgcatcagaatatatgagtggagtgcagatcagacattttggcggaatggagcatatggatgagttctgcagacaatattatgggacagaactttatcacggaatccgtaaatacgagcaggaaaagtatttgaaagaaaaggatctgcggaaagaagagaatatgaatataatgcggacggagctttttttggatgctgagcaggaattaaaaaaacatatggatcagaacgtttttttcgttgaagcgccgaccggaagcgggaagtcgaatttggctgtcaacttaagctttcagcttatgaaacagaaccctggtatcggaaagatattttatgtgtatccatttaatactttgattgaacaaaatcttgagtccatggaaaaaatatttgggggatcaaaggttatggaggacatcgcagtggtaaactccatgaagccgattccaatggaccgggccaaacgaaaaaccgatgagcttcaatattatcaggaagcactgctgaaccgccagtttttaaattatccgatgatcttgacgactcatgtcagtctgtttgacacgatgtttggaagaagaaaagaaagtacctttggatttcatcagctggcaaacagcgttcttgtattagatgaaatccagagttaccgaaacagtatctggacagagattattttgtttttaaaagaattcgcctcatttcttaatatgaaaattattataatgtccgctacactgcccaacctggatgtgttatctccgggacttgaaaatgccgtgcctctgatcaggaacagagaaaaattctattcccatccggtttttaaaaacagagtacatgcagattacagtcttatgaagaaagaatttaccatggaagatctgctggaccatgttttaaagcagcagaatcttaagaaaaagatcctggtagaattcataaaaaaagaatctgcgtatacattttttcaaatgcttcaggaggatggacggctggaacttccgacggaactgctcacaggagatcagagtattctggagagaaagcaggtgctgaaaaagattgatactgcaggaaagcagggcatgattttggtgtcaacccaggtgatcgaggccggcgcggatattgacatggatattggatataaaaactggtccaagctggacagtgaggaacagtttatggggagaatcaacaggtcctgcaaaaagaaaggtgcagtcgtatacttctttgaaatggatgatcctcggcatatctaccgggatggagatgccagaattgagaatctggagtatactttggccaatgaagagatgagaacgattctttcagaaaaggattttcagaaatattacaagtctgttttagaggtgttgaaacaaacattcatggaaagtacgggagatcacggaattgaagctttctttgcgacaaaacttgggctgttagatcatcctgaaatcgaaaaaagaatgcagctgatccaggatgacatgtggagtatgtcggtttatctttgccggaaggtggaggaggaagatgggactgtggttgacggaaaggagatctggaacaagtacaaaaaacttttgatggatcagaaaatggattattccgagaaaaaatataaactttcagaagtcaggagtaagatgaattactttacttataccatccagagaacagtcctaatgtatagtgacaaaatcggagagctttatatgatcgaggatggagagaaatatttccagaatggaaggctcaataaaatactgttggaaggaaaggacgggacaccagattttttgtaggatggaggaatcatatggagatcaatggtacgttaatcaattattattttcactgtaaacggcagtgctacttgtttggaaatcgaatgaacctagaggataacagcgaggaggttaagatcggaaaggcgattcatgagcagaaagcagagcagggaaaaaatacagaactggcgcttgaaaatattaagctggaccgtttgacgaaggaatatctgacagagatcaaaaagtctgatgcggacccggaagcggcaaggtggcagattttatattatttaaaagtgctgaagagaaacggaattatcagaaaaggaaaacttgaatttgcagagaaaaacaaaaaagacaagaaagttaaagtcgtagaactgactccggaattggaagaagaattgaggctgtatgaggaacaaatccgatcattgctggaaagtgaccaagttcctgaagtattaggaaagccaaagtgcaaaaaatgtgcgtactatgagtactgttatatcgagtaggaggagaaggtatgggaagtacgaaatatattacatcgatgggagaattaacacgaaaagataattccttgtgtttcagaaaagacggaaagaatatttacatacccattgaaaatacaaaagaaatttattgccttaatgaggtttcaatgaattcaaaacttttagactttttatcacaaaatcatgtggttgtacatttctttaactactatgagggatacagcggtacattttatccgagaccccaatatatgagcggcaggctcttaatgaaacaggcagaggctcaccagacgaagcggatagaaattgcaagggccattgcatgcggaatcggagaaaatatcagggaggttttatatcattattataagcacgataatgacgaagtaaagacaacgattgattggcttggaaatgaattcatcaaacaggtaaatgcagcatcagatattaaacagctgatgtcggcggaaggagaagcatggcagagattttatcaggattttaaaagttttcttctggaggactttgttatgaacaaaagggtgaaacgtccgccggacaatcctatcaatgctttgatttcttttggaaatactcttttatatacgaagacaatctcggcgatttaccggacacatctggatcagagaatcagcttcctgcatgagccgtcagaaggaaggttttcactgagccttgatatgtgtgaagtgttcaaacctgtgattgtatatcggacgatttttgacctggtaaatcgaaaacagctgaaagtagagaagcattttgataagagagtaaactactgtctcttaaatgaagatggaagaaaaatattcattgaagcatttgagaagcgaatggaaactgcattccagcatccgaaattaaaacgaaaggtgacgtatcgaactgccctgaaattggactgttataagctcatcaagtttatattagaggataaagaattccatccgttctgcctgaaggagaagatgtagatgaaaaagaaaatgaattataattatgctttcgtcttttatgacgtaaatgaaaagcgtgttcaaaaggtatttaaaatctgtaaaaagtatctgacccattttcaaaaatctgtgtttcggggagaaatgtctccatctaagctgatcaggctcagaaatgatcttaaaaaagtgctggatgaagatgaggactttgtctgtattatcaaactgatgaatgataatgtgtttggggaggagatcctggggaatccggaagataatgtgggagaaagtttaatactgtgacatcttccacatgatttctgttcggctcttagaatgcctcactccaatcatgtggaaaatggacgtaatgtctgttggagaaggtcctctgaaaaaagggtgccgcttttcgaaagttatttaccactattggaggagcgcatttcaaaagcgcgacggaaatagtggtgaataactcatacccacagggcacaccgtattttatacccttcgggtgggtgcgcttcgcgcgataaggtatacccacagggcacaccgtgttttatactcttcgggtggacgcgctttgcgcgataaggtatgacattttccacatgattttcgttcggcccttagaatgcctcactccaatcatatggaaaatggacgtaatgtccgttggagaaggcccgctgtcaaaaaaggtgccgcttttcgaaagttatttaccgctattggaggagcgcatttcaaaagcacgacggaaatagtggtgaataactcataatatatggggagatcagtggatcgtcctgctgaagatactgtaaattaagtcttgagattgagtttaatttcacaaaaaggaaggcgttttcccaaccttgtttttattagaaatggaagaaagctcggttttatgcgggttaggagaagttatggaaggaaattgaaattatagagcggaggttgggaaaatatctaaaaaacgttgaaaaataagggtttatagagtatcatgaaaaatagaaatggcttaaaagcgttggattaataaaaacattagatgtattgaaattcctcctatctgccgttcaaagagctgtttttccgattaataaaaacattagatgtattgaaatttgacccactgttctccggccagccaggcgatcacgattaataaaaacattagatgtattaaaatgatatgatgtttattggtcggattaccgataatagattaataaaaacattagatgtattgaaattccaatatttgatactcaaggccatctacatttatgattaataaaaacattagatgtattgaaatattcaatccgttggctcctctctgacaaggaaaggattaataaaaacattagatgtattgaaattataatcaaaagatagcaattcaaacgtatcaaacggattaataaaaacattagatgtattgaaatgccttgcacattgttttatttatatctttcttaactgattaataaaaacattagatgtattgaaattggcatcgttcacggcctcctcagcgtcttccttgattaataaaaacattagatgtattgaaattagcctctgcgccctgagacgctcttttggaactggattaataaaaacattagatgtattgaaatattccttcccatcctttgtatatttcagggagaaatgattaataaaaacattagatgtattgaaattcgagccagggaacgcatttggcagcacaacgaaagattaataaaaacattagatgtattgaaattctgcagttgcataaggatcatcttttgccacatagataaacaaaaacattagacatactgaagttcttttctattacataaattttctacaattttatctttaaaatataggtgaagaatttttttggaatttgttgagaaatcaggatgattgtagtaaaatagtagatagaatggttaaggatttggggattcagatataaatatgatgaatgagaatgtcttacagagatatggggaccaattcgcttcaaaatgggataagaaaaagaatagtaaattcattagaatagctgaagatagctgttcttacaagtgtgctttgcatagatataattagacagaagttgtaaatatacaatttctgtctttttctttggttaataaaggggatgagagtcagttcaacaaaatggggtatggtaattataacttgattcttagtaatgtagagataaatttgtatgaaaagaaaatgtaaatattaaacaaaaaggagaaacagctgttataacaacgctgagtattgattatgagatttctagtattttatcgaaatgaaacacctttacatatgggaacaggaactgaattaggggttgttgacctacctatacaaagagaaaagcacactgggtttcctaagggagaggcatcgagtattaaagggacttttagaagtatcagtgaatataaagactattttggaaaagagagtgatagtgaatcggatcagggagaaccaggaaagatttgctttacagacgccaggattctatttctacctgtaaaaagtagtggagaagagttatttgtatgggtgacatgtccatttgtattaaataggtttttaaatgagattgatggatctaaaaggtttgagaaactaacaaaaaagttcagagaatgggaagaaacacttgatgataataaaataattatgataggtaaaaatgaagatccaggagataaaaaaatactggaagattttgaatttcaagttcaggaaaataaggaattaaaatttccttcggattttatcgtttcagagaaagataagtatctaagaaataaaatacaaaatgatatttacatggtcagcaatgatatgttttcctatttttgtgaattcagtacagaggtgattacccgaattaaaattggagataacggagtcgtacaggatggcggactgtttacagaagaatttttgccggaacagactatactatataattttgtagaagatatgcagaattgtgataaaaattcttttgctaagacaatattggaggaacagggggaagaaataaaggaagcagaatcaaacatattccctagagttgagggaatgattcaacttggcggagatacgacaataggaaagggaattacttctttcgtggcaactaagacagaggggggcaagtaagttgaaatcagaaaaggaatgtttgacttatataatggactgcatgaaagaatttagtagttcggatataaatctcctcaaaaaaataccagcttatgtctataaatttggactggattatacgatggagtttttgtttacaaagaggtcagaaaatgattctgagagacatattttccagttcatataccattatttgtttggtgaagaagggatgaacaaagatcaatgtaaatttccttctgataaccgaagctatgctgagtgtgtgagagatacaatgaaattatgtaaaactgcaatcttgatctctgttcatcctgaaagcaataatgccaataaaaaatataatgtccaactaaaagggaaagaatacatgactagaattgagcatacagagcaagaacttttggatattcaaaatccatatctacattattattttaccagttccaaaaaaggtttgtttgtcagaactcctaatatacctaaagagtatattcatcataaaaaaaataagatacagtcaatatattcaaaagagaaatggcatactttaaactttcctttgcaaagatttggagaaagcagaatgctgattggggcaggtcaaacaatcaagaaagacttatattttcatatgaattttttatatggtatccctgagctgccagcgacagcaatcaaaggagtcttccgttccttttgtgaacaagatgggcacatatctgaagcaaaaatcaaaaattggtttggcgatgaagaaaatgaaggacaaattatatttttaactgctacaccggaacaatacacaataaaaaaggatatcatttctaatcaatatggtaattattatcagcaatcacaaatcggaaaagacatggattttccaacactaaaagaaccaaatttggtaaatttctatgcagtagaaattaaagatatgacgatacaaatgataattggaaaagacaatagggataaagatgatatagaaaaagcatttcttgagtgtattcaagtatgtaattttggggcaaaaggggcggttggttatggctatcttgaaaaaaagaattaagttagaattaataacggctatggggacacatggtgctaataataaggaattagaatttcgtattacagagttaaagtctgccatgagattttggtggagagctgtacagtgctttgattccgcagaagagttgtaccgtagagaatcagcattgtttggaagtttaggtagaaaggctccggtcagcatacgtcaatataaatttgatagaccaaaaacagaacttgttaaattagggaaagggggatctggaaatttttttaaggttggagaaacgattgaaattgaattgctttcctatgactctgagaaattagatgaatacttgcaaattttaaaactgacctcttatcttggaggaatcggacaaagaagccggaaggggtatggagcctttaaaattgttgaaattgatggcgatattgtaccaatagaaacagatataataagtgtactgattcaattaatttctgatataacggataaaaaatatataaagtactcatatgaaaagaaaaatattgctcttaataggaagaatactcaatatttatgcttgaagaagatcaacgttggaagagtaagaggaagggataaattttttgatgatttaaagagatgtatttgcaagaggaccagaacaaaagagtacttattaaatgtatcttgttattgtggtggaaattcaaaagtcatacctgttgtcagtgaattttgggtagatcaatataatgattttgttgaaaattattgtcaaacatacattaagtatttaataaaggggtaattatgggagaaaagttactgttggtatcagtcagcggtgttcaagaatacattagtcgtgccaaaaagactgcagatctttacggaagcagtcagagagtcattaagcagattttatggataaaaaaaagaattcaaaaggagtttgaatcctgtgaattattgctgggtgagggtgttgtcggagatcctccgaatttttttattgctaaattacagacagataaaacttctgaagaagtagaaaaacagattttggatgtattgatgaaagaaggagagagatgttctgaagatctgccatgttttattaccgtatgttctacgaaagagaattatcaggagacatataaatttttgtaccgaaaatttcaagcgtataaaaataataggctgaacgcatttttgccgaaacaagaatctgaagaacaagtgacatcccatatttgtagtatttgtggaattcggttagctgacgctctagttgatgaagagtatttgtgcaacgaatgccgtaacaaaagaaaagaaggaaaacgcattgcatttccatcaacagagaactttggttctctatattacgcactagtaagaattgatatcgatgatatggggatgtacatctcaggggaaaaaggatgggagagggatgaggaattacataattatcagaaaaaaataagtcgggcagcaaatgaatttttcataaaagagaaagaattcattaaccaaaaggtgaaaaaagtaacagagaacgagaacgctgtgatctatgccgggggagatgacatgctctttttttgtcctgttttttgtatagaggatattacaaagaagctggagtcagactggactgaaatgtgtgattcaggaatgacattttctcaaagtattatagttgcgcactgcaaggagccgcttcgatatgttctgaaaaagtccagagagagcatggaacaagtaaaacaacattatagaaaagacggaaaagggggatgctgtttctctgttttatatagaggcagtggttcaagaatggtttttgtaaaaggcgatagaatgcaggatcatttttacagcctgatttccgcgttatgcaggcatcagttttcaagaagtgttatttttcaaatggaagaggaattcacgggctggggagaaaactttggtgtggatgaatatacagatttaagattcatcatgaataatgagacaaaaaggattgtgggaaggaaaagcgggggaaagagttctgaggaaaaacaagaattaactgatttgttaattaatctaagaactgatgttacaaaagaagccaaagatggattttacatagactttaatgcttattttgatctgatgcatatagcagagaaattagcatctttcagtgaaaaataggaggaatgggatggggatcattacattaaaaatagaaccgtgggatacagttatgtttcgggatgggactttattggataaaaaaacatctaattatgtggaaagcagattttttccatatccctctgttttttatggggcaatatgtacgagtttgatggaaaatgggtatttgaatgaggttcataaaactcttatagaaagaaatacgacactactggaagatgttttaaaagagaatttaaaaatcagacagatatacttagagatggagaatgaaatttatcttcctgctccaagagatcttatagtaaatgaggatggtgatattcgggaaagtaattttcaaaagggattgctttatacgaatccacagcttcaagaaaaagtcaaaccagcttcgggaaaatatatcagtttatatgaatttatgacttgctatgatatatctgaaaaagaagaaatttatttaaaaaatcaacaagagtttgcaggtgaatatcaaaagacaggaatagaattggaagataataagaagatagcaaaaaaagaacatctatattttacaacaatgaaagattatacatataagaatacttgctttcttatcgaggcagagatacatgatgaaatatcaaagggatttagagcaaatattttattagggggagaggccaggatggccaggctggaattatttttggggtcattggacgagtatcataaagatattagagaatataacaaaaagaaaagcagcagtgaaaacttaaaattaatctttaccacaccgtttattatgaagaatgagaaaagtctggagagtgtattaaaagaaaaaggaatttcggtcttgtcaaagattataggaaaaccagagacagccggaggatgggatatggcaaagaataagcccaaagaattgaaaaaagtcatcccagaaggaagtttatatctgttaaaaagcagccattttaaatctaacacgaatgaacaaaataaaaatttattatcagagatactgtcggatgtaattgttcaaaagcatcgagggtttggcagttttatactggcaaatgaggaggctgtctatgactgattttgaaaaaagatggagacaagctcaggaaaaatgcgatatatatgtcatgtgttctacactaaatcaaattgtaaattatctgccattagaaaatttaaaaaatcgggaaagtaaatctttagaaattataaatttgacttatgaagacggggaaaataaacgattttcaaataggatgtgggacgaaaatttttctacagtttataacgacaaatatgagggaatgccatggattgactctgatgatataaaattacctagaagatttaagtgtgaaaattatattagagaaattgaaaagtgtattggtgccagaaaaaataaaaactttatttggaatgtcacgggaggacagagaaatatattatttaccgcaatgaaatatatagaggataatgccgatacaagttcaaaccatacagtcatgtacttggagggcaatacccagaagattactgttggctattatgatagaaatgagtggaaatttggagctgtaaacaatagttatagaagcgatacaatagatttacacaacctgtttcgtctggcaggatacgaaacggatatcagtgatgctgtatttattaacgaaggaaaaaacaaagaagattttttaaatctgctgaaggcttattctaatttttattccaaactatatgaagtaaatgaagaagtacggaaaaagttaatcgagtcaaataagtggaataataatgatgataattcaaaggatttttttgaattgctagactgcataaattgtgagaagaaagtaactgttggtgatattgagaaaataaaagattcgttagataatagaagcaattatcttttcggatattttctggaatatatggcggcagcagtgatttggaatgcagtaaaagaaatgtcaaagcaagatacagatttttttcagagtttatctcatagtgtaaaagtatgcaaacatgattggaatgagaaagaaaagttttgtgaattggatcttgtcttattgctgagatcaggacaaacagttgtctttgaatgtaaatctgggtttatgtcagcagaaaacgcaaagtcacgggagcatacagcttatgcgttaggcggtgtatatggaaaacctatattgataacaccgctgagcaagcgtgaggcagtagaagatgtaaagtctgatggatatgaaaatataataaaggcatattcatctgcacgccgggccggattggaagtttttcatttggatactcttaatgaggatttaaaggatttgttcaaagatgcactgtgagaaaaagggggcgaatattatgagcattaaaaacagagcaaatgcagtttggtgtatagcaaatacgccagtttgtgcagggtcaggcgaaggagattttagatcggactgcaatatccaaagaagtgatgatttccctaaaatagatgcagggacgttcaaaggaagtctgctctataaaatggatggtaagctaaaaaaaacaattcaaaataaatcaccggagcaggcaaaactttctttttcagatttaaggctgctgtttttttccgttcaatcgtcacatgggatttacaggcttttaacaagtgtaaactgtttagaacaattctttttagaaatttcatggaacgaatatgaatgtgataatgtttaccaagaattgaagggactgaaaaggcgggttgtagatggtgtgatatgtcagtggtctcatcacgatgatacagaatggattggaggatataaattacaggctgttaactataaagataatgtgataaaggatcttttaagaaagcttggactttcccaaacagtgatcaaacatattggaatcgtatctgataaagattttagatattttactagatatcatacagagattattactcacaacagactcgaaaaccaggcactgtttacagaagaatatttgccggaaggaagtattttgtatggatttatttgtgaattcaaggatcttgtcagaccagtaaaagcacctgtgcttcctcaaatttctagattaattgaaacgaatgaaaaagaaggtaaagtatatcaaattggaagaaatcttaatactggaaaaggaagtgtgacaatcagtgaaatgaaaagggaggaagtaaagaatggaaaatcactttgtagatctaaatcgtcgtagggcattggattcctatcatgtaatcaactacctcatagaatatattgaagaatcaaaagatcttggaaatccaaaagtacagggaagtataaaaagcaaaagagagcagttaagaaccatctgcagaaaacttccagttcttatgagagataatggatttatcattacttttgcttttttaaaaggaaaagggacgtcttcaatagaacagaaaatatttgagcaatcaatgaaatggatttcatttgtcttttcaattcccaaagaggcggacaatgcatttacctacataatcaatgaagttagtcaaaaagaatatatgatgatatccagggagataattaaatattttgtttggttaaagagacatgctgaaatggaaatttctaattgacttttcacaaactttattatattattgtattatatcattaatacaaaaaaggaggcgcattattcatgcaaaaaaagctgattgccccgatcattgtgacggttatcacaatcgcatttttattaggttacttcggaatgatttttgtgctcattccattatctgtcggtctccgtctgctaatcggtatgatcccgctttgcctggcaggtgtctccgtctatgtactcgttgaacgcattaaggaagtaaggagtggtgaggaagatgatcttagtaactactgaaacaataccaggaaaagattttgaagcattaggaatggtcaaaggcaatactattcagaccaaaaatgtgggaagagatattacccagggctttaagcatttggttggcggtgagttaaaggcctatacagagatgatgaacgaggccagggctcttgccacaaaacgtatggtagaggaagcagaagcattaggggcagaagcagttgtatgtgtccgctatgcatcggcggaagtcatggctggtgctgccgagattatggcttatggcacagcagttaaatttaaataaagaacgcaggtgtaagaaaatcttttgactgagtcaaatcgtatctggcacgcaaaattgtcaagttcctcaaaaagagaggggcttgacaattttgttttaaatgattttaatgaaatacagagaggggaaaacggaaggaagagaatttgttattttctggggagagtgagactgtggaaagtaaaaaaggattaaaattagttctaaagaaaatttacaatttattggacggaaaacagaaaagaaactttgtattaattatattgattatgattgtgtctgctgtcttatcacagattactcctaaagcaatcggatggctgacagacgatatgctgatacaaaatcaaattaattttttaaaagtgataccgctgctgtttcttattttggctgtcaatgttataaatgaacttatgaagatactgcgcagaatcatggttgaagatacggcaactaaaacagaaaaaaaggcaaggggaatcgtgattacatcgcttctgaaagctccgttattgtattttaaggaaaatatgacgggaaatattcatggaagattaaatcgatgtctggagggaaccattaaacttgaaaaactcatttttatggattttgctcctgcaatttttaacagcattgcggcgatcgttgttatatttactacgctgcctgtctttctggctttgccgatgcttttagttattccgattggaacggcgatcgtatttcggcagatcagcacccaaagggggatacgcatcgaattattagaaacaaaatcagctatggacggagcgatcgtcgagttattaaacggcattgaagtcataagaatgacggacagcattgtattagaagaaaagagatttgacaataaatccgagtttttaagaaacaaagaaatgaatcatcacatacaaatggcgaaatatgacagcctgaaattcttcaatgaagtgttttttacggtcttaatgataggagtctcagcatatcttgcaacgcagggcataatcagtgttggagcggttctgacttcctatctctgtttttcacagctgattaagccattggaagaactgcacagaatcttagatgaattatcagaaagtattgtgttagcagaagacttttttagaatgacggatataccccatgacttttcttattccacagtttgtgaaagttgcgaaaataaaaacagaagcagtcatataatagatattcatggcctgaatttttcttatgatcagaagaatactattttaaaagaattaaatatctccgttgaaaaaggaacctttttggggatcgcagggccaagcggctgtgggaaatcatctttgataaaagccatatgcaaactggaaaaatgtgaaggagatatctttattgacggtgcaaatattacttcactatcaagaaaagaaatgtcgcagattatagctttagttccgcaaagcccgtttttaattgcaggaacgatctatgagaatatctgctatggcctggacagagaagtgagtcaagaggaagttgatgaggccgtcataaaggcaaatctttatgattttataaacagcctgcccgataaaatgaatactttaatatctgaaggaggaagcaatttatcagggggacagaaacagagaattgcagtcgcaagaatttttttgagaaaaccaagcgttttgattttagatgaggcgacttctgctctggataacacttctgaaaggtttattcagaatgaaattgaaagactgaaaaaagaaaataatatgacgataatatcaatagcgcacagactcactactttaaaaaactgtgataagatcatagtcatgaatagaggggaaatcgtgcaggagggtaaatatcatgagctgatacagaaagagggcatattcagtcatatgtattacggaaaactaaagtagaaatcctgctggtttcgtgtataataatacacaggagtgaaaatgatgaaagaaaattatcaaaaaaagctggatggtatcatagaagggcttcagggaaagaggccttctcttttgctgcacagctgctgtgccccgtgcagcagttatgttttggaatatctctcgaagtattttcaaatcacagtgtattattataaccctaacatcgactccgaagaagaatacgagaaaagggccgaggagcagaagcgtctgatctcggagatggaatttccggataaggtatcttttataaaggaagagtttcgtccggaagagttttatcaggcagtcagaggatatgaaaaagagccggagggcgggaagagatgtcttcggtgctatcggctgagactttccgaggcggcgaaaaaggcaggagaattggggagtgactattttaccacgacacttaccatcagcccgctgaaaaatgcccagtggctcaatgaaatcggtcaggaattagaggcgcagtatcaggtaaggtttctgccgtccgattttaaaaagaaaaacggttataaacgttctgtggaattatcacaaaagtttgacttgtaccggcaaagtttttgcgggtgtgttttttcgaaaaacgaaaaataattgtcaaaaacccttgcaaaaggtttttatttgtgatagaatttttacaatttgtagagagatatatctaaaataataccacatattgcattgaactgcgtctgcgcatcaatgcttggattcgtgatttttatttttggatatattttttttatgcacatttttaaggaggaaacagattcatggacgcatttttgattttggaagatgggcaagtgtttaaaggaaaaagtttcggcgccaggaaagaagttatctgcgaagttgtattcaatacatcgatgacaggctacctggaggtgcttacggacccgtcctatcagggacagggtgtcgtcatgacatatccgctgattgggaactacggcgtatgtcttgaggatgcagaatccgtaaagccatggcattcagcttttattgtaagagagttatcaagaaccgcaagtaatttcagaagtgagcaggatttggaaagttatctgatcgccaacgatattccaggaatccagggagtggatacgagagcgatcacgaagattttgagagaagaaggctgtatgggaggcatgatcacaactaatccggactatgatctggatgagattcttccaaaattaaaagggtatcaggtaaaagatgcagtcaagaccgtatcaagaacagaaaaagaacattttccgggagacggactgaaagttgccctgttagatctgggcacaaagagcaacattgcaaattctctcaacaaaagaggctgtgatgtgaccgtttatccggcgtttacaacggcagaggaaatccttggggatcagccggacgggatcatgttatccaatgggcctggagatccgaaagaatgtgtgtccattataaaagaaataaaaaaattatatgacagcgatgtgccgatcttcgcgatctgtctgggacatcagctgatggctctggcaaacggagcggatacgaggaagatgcgcttcgggcaccggggcggaaatcatccggtaaaagatctggctaccggccgtgtctacatttcttctcagaaccatggatatgtgatcaaaaaagagagcgtaccaaagaatctggcagaaatctcatttatcaatgtcaatgacaagagtattgaaggactccggtataaggggaaaaatgtccgtaccgtgcagttccatccggaggccagtccgggaccggtagataccgcttacttgtttgatgaatttattgaaatgatgaaaggagcaaaaaatgcctaggattgaaagtattaagaaagtattagtcatcgggtccggaccgatcgtcatcggacaggcagcagagtttgactatgcaggaacccaggcctgccgcgcccttcaggaagagggaatcgaagttgtcttggtgaactctaatccggctaccatcatgaccgataaggatatcgcagataaagtttacattgaaccgctgactgcggaagttgtagaaaaaatcgtagaaaaggaaaaaccggacagtattctcccgacattgggaggacaggctgcactgaatctggcgatggagctggaggaaaacggcttccttgaaaaaagcggagtgcgcctgatcggtacctcctccactacgatcagaaaggctgaggaccgccaggaatttaaagatacgatggaaaagatcggtgagcctatcgcggcaggaaaagttgtcacagacattcctgcgggtgctgagtttgccgaggagattgggtacccggtcgtctgccgtccggcctatacgttagggggaagcggcggaggaatcgcccatgacagagaagaattagaagtgatcctggaaaatggtctcaggctgagccgtgtcggagaagttctggtagagcgttacatcggcggatggaaagaagtcgaatatgaagtgatgcgcgatgccaacggaacctgcatcaccgtatgtaatatggaaaacattgacccggtcggcgttcataccggagacagcatcgtagtagctccttcccagacattaggggacaaagaataccagatgcttcgtacttctgcattaaacattatcacagaactgaaagtaaacggcggatgcaacgtacagtttgctctgaatccggacagttttgaatattgtgtcatcgaggtaaaccctcgtgtcagccgttcttctgcgctggcatccaaggctacaggatatccgatcgcaaaggtgacggcaaagatcgccatcggatataatctggatgagattccaaatgccatcacaggaaagacttatgcaagttttgagccgatgctggattactgtgtggtaaaaatgccgcgtcttccgtttgacaagtttattcatgcaaagaggacactgaccactcagatgaaagcaaccggggaagtcatgagcatctgcaataattttgaaggtgcactgatgaaggccatccgttccctggaacagaacgtggacagcctgatcttcggtaattatggggaaatgtcagacgaagaactgacaaaggaattagagaagatcgacgacttgagaatctatgtgatcgcagaggcgatccgcagaggatttgactacgacacgattttcaacatcacgaagatcgaccgctggttcttggacaagattgctgttttggtagagatggaaaagaaactgaaagaagcaggagaattggagaaagaactgctggcagaggctaagcgcttagaattccctgattctgtgatcggaaagctgacaggaaaaactgcaaaagagatcaaggaactgagaaaccaattcggtattcatgcggcttataagatggtcgatacatgtgcagcagaatttgaggcgagtactccttactattactccatcttcggaagtgaaaatgaagtagaagaactgagtaagaagaaaaaggtcatggtactgggctccggaccgatccggatcggacagggaatcgagtttgattactgctctgtccacagcgtatgggcattaagagacgcagggtatgagaccatcatcgtcaataacaacccggagacggtttccacagactttgacgtggcggataagctctattttgaacctttgactgctgaggatgtggagagcatcgtggatctggaaaaaccggacggagccgtggtacagttcggaggacagactgcgattaaactgacgcaggctctgatggagatgggagttccgatcctcggaacaagcgcagaaaatgtagacgcggcggaagacagagaactgttcgatgagattctggaagagtgctgtattccaagaccgaaaggaacgaccgtatttacatgtgaggaggcgctttccgcagcacatgaactggggtatccggttctggtaaggccgtcttatgttctcggcggacagggaatgcagattgctgtttccgatgaagatattgtatcctttattgagatcatcaaccgccagacacaggagcatccgatcctgatcgacaaatatctggtcggaagagaagtggaagtggatgccgtatgtgacggggaagaaattattatccctggtatcatggagcacatcgagcgcgccggaatccactccggtgacagtatttctgtttacccgtccattaacctgagcgaaaaggtgaaacgggtaatcgcagagtatacaaggaagctggcaaaatcactgaacgtcattggactcatcaatatccagtttattgtctgtgacgaggaggtttatgtcatcgaggtaaatcctcgttccagccgtaccgttccttatatcagcaaggtaaccggaattccgatcgtagatctggcggctaaagtgatcgccggagccaagatcaggaatctggaatataagccgggactccaggaagagtctgaatattatgcgattaaaaaaccggtattctcctttgaaaaactgaggggcgcagaagtcagcttagggccggaaatgaaatccaccggagagtgtctgggagtttccaaaaactacaatgaggcattgtacaaggcatttctcggagcgggcattaaccttccgaagtacaagaagatgattctcacggtgaaggattcagataaaatcgatgcggtggatatcggaagaagattcgtggatctcggatatgaaattttctccacgaggagcacgtgcagagtgctgaatgaaaacggcgtgcctgcccatccgatcaacaagctggaagaagaatctccgaacttgcttgatttgattttagatgataaaatagatttgatcattgacacaccttctcagggagtagggcgcagcagggacggattcctgatccgcaggtatgcgatcgaaaccggtgtgacttgtctgaccagcctggatacggcagatgcactgctcaccagcctggaatcaggaagcagagacaatttatcagttgtggacattgcacaaatttaaacgtacaacggggtacctttaagtctattaaaggtgtcccttttttctttcatcggaaagttctatttcaggagggcggtgttccctctgctctgattgacaataaaaatgtaacttgataaaattatgttaaccgccggctgtaatttaaagccgaataaaaaagaaaagaggagtgatgatatggaccgatatactaagcaggacgtcatagatctggtcagggaaaatgacgtacagtttatcaggctgcagttttccgatgtgttcgggacgctgaaaaatgtggcgatcaccgcaagacagctggaaaaagcattggataataagtgtatgtttgacggatcttccgtggacggttttgtgcggatagaagaatccgacatgtatctgtaccctgatctggacagttttctcatatttccatggcattcccagagcggaaaagtcgcgaggctggtctgtgacgtgtacggacaggacgggcttccattcatcggggattcccgctatatcctgaagaaagtgctcaggaagagcaagaaactcggatataattttaacgtagggcctgagtgtgaattctttttatttcacacggacgaggaaggatgtcctacgacgctgacccacgagaaagccggctattttgatgtggcgcctctggatcttggagaagcggccagaagagatatgatcctgaatctggaaaatatgggatttgagatcgaagcctcccaccacgaggtggcaccggctcagcatgagatagattttaaatacgacaatgcactgcgcactgcagataatattcttacatttaagtttgtcgtgaaatatattgcaaaacggcatgggctgtatgcgagctttatgccaaaaccgatctccggtgtggacggttccggaatgcaccttaacatgtcgctttggagcgaaggacagaatatgtttgcggattccagaggcgaactgggactcagcgacgaggcgtaccactttatggcgggtcttatgaagcatgcgccggagatgtcgctgatcacaaacccattggtgaattcctataagcggatcgtgccgggatatgaggctccggtggatatttcatggtctcctgcaaacaggagtccgctgatccgtgtgccaacggccagaggaagcggaacacgcctggaattcagaagcccggattccgcggccaatccttaccttgcgcttgcagtgagtctggcggcaggaatcgacggtcttgaaaataaactgcagcctggaaaggcatctacaaagaaccagtacgaagttacagagaaggcgaaattaaaggccggcatcggggctcttccaagggatatgaaggaagctatggatttgttcaaggacagtgaattcatgaaagaggttctcggagatcatatttttgaccggtatctggatgcaaaacagggagaatgggaatcctatcagaaaactgtctctcagtgggaaatagatgaatatttgtacaagatttaaccggcagaaggcaggcgtcattcatacggggaggtgggaagcttggttcatatttttgttcttttcccgaaacaggagcagacaaggagtatccgaaatctgcttgtgagaaacggatttgaagtgacggctgcctgtgtcacaggctcccagatcatgcagcgggcggaaagcctggaagacgggctgatcgtctgcggatacaagtttgcggacatggtctgcagtgaactgagagaatatctccctgacggattcaggatgattgttttagctccacaggcgagtctggaatttttggatatccgggggatggagtatctgccgatgcctttaaagcctccgcttctgatggaaaaagtacgggaaatgtcggacgctctgaacaatgcccagaagaaaaaacagcaaaggccgagacagcgcacgagagaagagctggaaataatcgaagaaacgaagaaactgctgatgaaaaacaaccggatctcagaacaggaagcccacgagtatattcagcgccgcagtatgaacagcggtgtgggactgattgaaatggcaaagatgatccgggattcatatagatactaaacggactttcacagtaaattattaggaggacatcatgtttaagatcaacgaaaattatttgaaattaccaggaagttatttattttcaaccattgccaaaaaggtcaatgcatatcaggaagccaacccggaaaaagatctgatccgtctgggaattggggatgtgacacagccgctggctccgtcaatcatcgaggcgcttcacggcgctgtggatgagatggccgcagcggagacctttcacggttatgcaccggacctcggatatgaatttttaagaaacgctattgtggacggtgattacagatcacggggtgcgcagattgaggcggatgagatctttgtcagtgacggagcaaagtgtgattcgggaaatatccaggagatctttgcacaggataataagattgcggtctgtgatccggtgtatccggtttatgtggacaccaacgtcatggccggacggacaggaacctatgatccgaaatccgagacatggagcgatgtaatctatatgccgtgtacggcggagaataattttgcaccggaatttccgaaagaggttccggacatcatttatctctgtttcccgaacaatccgacgggatctacgattacaaaggatcagcttcagggatgggtagactatgcaaataaaaatggggcagttattatttatgatgctgcatatgaggcatatatctcagaggatgatgtggcacataccatctacgaatgtgaaggcgcaagaacctgtgccattgagttaaagagtttttctaaaaatgcaggatttaccggagtacgattgggatatgctgtagtgccgaaagatcttacatgcggtgatgtaaaacttcacgacttatgggcaaggcgccacggtacaaagtataacggcgcaccgtatattgtgcagaaagcgggagcggctgtctattctgaagccgggaaagcacagcttaaagagcaggtgggctactacatgaacaatgccagggtgatctatgagggtctgaaagatgcgggatatactgtgtcaggaggagtcaacgctccttatatctggctgaagactccggatggaatgtcctcctgggatttctttgatcatctgctggaacacgcaaatgttgtgggaacaccgggatcaggtttcggaccgagcggggaaggctatttccggctcacggctttcggaaattatgagaatacggtgaaagccattgaacggattaaaaatatataactgtattttgcaggaccatgcctttgccggcatggtccttttaatgttcctgacatagagttttgtcaaaatatgacgattcattgacattttacacagaatgtgttaagttaattttaataatgttgtaataagttcacaatacgcaggaaggagagggagacacagagggatatgaagcataagatagcaaagggaacgatggcagccggactgtcactggcattcattctcggagtttccacattcgcagacgccaaaggcgatcagtaccagaccggtcttgcgggatctgcggcagctatggaacagtacacagagtcagacagttcagcaccaaagaagaaagtaaaaacaccttcggctgcagcagcagtgaagaagacgacaaagacgcagcatattacagaagttaaaaagcaggcggcagcgacttccgcaaaaccaaaagtgacagcaaaacagccggccgcggccgcggtgcagaaacagacaaaagagcctgagttttccgcttctttttacagaggaaaagcagcacccaatgtacgctccgtactgaacatcagaaagaaaaagagcatttccagccctgtggtcggaaagttcaaaaaaggaaacatcggcacggtattgaaaaagggaaaagaatggagcaggatccgttccggaaaagtgaccggttatgtgaagaacgagtatctgatctggggaagtgatatccacagttacgctaagaaacataattttccgaaacaagccgtcgtgaaagtggacacactgaaagtcagacagaaacagtctaccaaagcaaaagttttgaccctggtctccagagatgacagctacaaagttctcggagaatccgcagagtggatcaatgtgaaggcagacggagacaaaggctatctggcaaaagattacgtcagtcttgggtattactataccagtgcaaagtcaacggtgaaaaaacaaaagccggcaaagagtaccacgagtacagaaagaacaacccagagcgaaagacagaattcctcttctcaggagagcggagacagttcctcaggaactacccgtcagcaggtcgtgaactatgccctgaagtttgtggggaataagtaccgctacggcggaaacagcctgacaaacggcacggactgttccggatttactcagcaggtgcttggacattttggctacaacatcagcagaacatcctattcccaggcaaacgatggacgcaccatctccatcagcagcgtcagaccgggggatctgctgttctataaacggggaggccggatcaaccatgtgaccatgtacatcggaaacggtcaggtcgtccacgcgagcaattccgccccatatccaaggggaggcatcaaagtatccagtatgggataccggacaccgtgcaaagcagtgcgcatcattaactaagtgagagaagattatttacatataccaagaaaccgccgcggttcacaaatgtgaaccacggcggtttctctgtaaaaagcaaatggaaccatccagtaaatattatgtccattttgaccggtttggaggccttgcattcgaagagatgttagtttttcttctttcagaaaaggctcggaggcggtgtgcgaagcacagtgaggctgtttgagcgttagcgagttccgaacgggctgccggagagactttgctgaaagttagaaaatcttacatctctgagacagcaagccggaaaacaggtcaaaatgtcacacattaaacttaaacacgatcacgtctccatcctgtacgacgtattcttttccttcctgtctcaccagccctttttctctggctgctgcgatgcttccgttttcaacaaggtcatcataggaaactacttcggcacggatgaagccccgctcgaaatccgtatggatctttccggccgcctgaggcgccttcgttccttctgtgatcgtccaggccctcgtctcgtcttcccctgatgtcagataactgatcaggccaagcagtgaatagctggcagagatcagtttgtcaaggcctgactcactaagacccagatcctctaaaaattcttttcgctcttcatcatccagttctgcgatttcctgttcaatctgggcacagatcacgaaaacaccggcgtctacatcttttgcataagttctcacttcatttacaaactcgttggatgcggcatcatccatgagatcatcctcacagacattggcggcaaaaatcacaggcttgatcgttaagagattgcaggaatccaggatttcctgttcttcttcgtcatcggttacgaatgtcttggccagcttcccgtcctcaagatgggcttttacccgttccagaagttctacctcccgggcgagggacttgtcatttcgggaacctttttttgacttggcgatccttctgtcaagaacttcgatgtcggaaaaaatcagctcaaaattgatggtttcgatatcgcgaagcgggctgactgaaccgtctacatggacgatattttcatcttcaaagcagcggactacatggacaatggcatcgacctcacggatattggccagaaattggttgccaagcccctcccctttggatgctcccttgacgagacctgcgatgtctacaaactcgataactgcgggaatgactttttttgagtgatacatctcagacagcacatccagccttttatccggcacggtaacgatccctacgttcggatcgatggtgcagaacggatagttggcagactcggcacccgcttttgtgagagaattaaacaaagtactcttacctacatttggcagtcctacgattcctaatttcattgtgtattgattcctttcttcatgtctttgcataaatatagtcctgtgatccaaggacattgatacaacaagtctaccataagaaccttgaaaagaaaagaaaaatgggataagatgaaacgacggaaaggagtaatgcgattatggaaaatgaaatccggtttccatttttgggcattgtgttcaaacatgtgggagagggcatcagcatcggaggatttgagatcaaatattacggtatagtcattgcactgggatttcttctggggatgcttgcggcggccagaatggctaagaaaaacggagtcaatccggatctggtctttgatttcatcatcgcggtgatgattcctgctatcattggggcgagactttactatgttattttttcctgggattactacaaagatcatctgacggagatactgaataccaggagcggaggccttgccatttatggagggattattgcttcggtcattgtgatggtcatcttctgcagagtgaagaaaatagaatttttcaaactggcggatattgcggtgccggggctgctgatcggccagatcctgggccgatgggggaactttttcaacagggaagcattcggaggctttaccaacgggcctttggctatgcagatccccacagactatttcgtaaagcacggaagactttcagagattgtggatgccgggctgtatgaccaggctgtgtttgtgggaagcggaagccatatgaatacttatattcaggtacaccctacgtttttatatgaagggctgtggaaccttgcactgctgattctcattgttatcatgttcagacacaaaaaatttgacggccagatgctggcaatttatgccatcggatatggagtcggacgattctggatcgagggccttcggacagaccagctgctgatcccgggaacacaaatcgccgtatctcaggtagttgcggcactttttgctgccggggcactgcttgtccttctctatcagtggaaaaaacggaaacattaaaagtgtagaaaaaaactgttcacagaaaaaattctgtggacagtttttttatttcttgattttttgtggacaatccattagaatggagacagtagtggtgagaagtggtggatagtgggtagaaaagaccacaaagtgtcacgactgatcatcaggtggagcgcacccggtttgggaaacggcaggtgattaccatgttcatgggcgaatacaatcacacaatcgatgcgaaaggcagactgataatcccctcaaagttcagagaagcactgggcagtgagttcgttcttacaaagggattggatggatgcctattcgtgtttcctatgaaagaatgggaggcttttgaagaaaaattaagaagcctgccgctgatcgataagaatgcacggaagttttccagattctttttggccggagcatccacttgtgaattggacaagcagggcagaatcctggtgccgggcacactgcgtgaatttgcacagatggataaagaagtagttcttacgggcatgctggaccgtattgaggtatggagcaaagaacaatggcttgaaaataatgcttatgacgatatggacgatattgcccagagtatgcaggaactaggtttgaatatctgaatggaaggaaagacaaatggattttgaacatgcatctgtgttgttggatgaaacaataagggaactaaagataaaaccggacggtatctacgtggatgggactcttggaggaggcggacatgcctttcatgtcctgaacagactctctgaaaagggacgatatattggcattgaccaggacgaggatgcgatcagggcaagcacaaaacggcttgctccgtttcaggataaagttacgattgtaagagataactatgtgaatatgccgaaagtgctgaaggatctggggatatcccgtgtggacggaattcttctggatcttggcgtttcctcttttcagctggatgagaaggacaggggattcacataccgcgaagacgtaccgctggatatgaggatggatcaaaggcagactttttctgcaagagacatagtcaatggatacagtgaacaggagttgtttcatattatccgcgattatggagaggacaagtttgctaaaaatattgccaaacatattgcagcagagagagagaaagcaccgattgagacaacaggacagcttattgaggtgatcaaacatgcaataccgatgaaggtgagggctgtgggaggacatcctgcaaaaaggacatttcaggccatccggattgaatgcaaccgggagctggaagtgttaaagacaagtcttgaccagatgatcgagctgttaaaccccgaaggaagactgtgcatcattacctttcattctctggaagacagaattgtgaaacgggcattcagaaaaaatgaaaatccgtgtacctgtccgccgaatttcccgatctgtacctgcggaaatgaatcgaagggtaaggttatcacaagaaagccgattataccgaccgaagaagaacttatgaggaacaaaagagcaaaaagttcaaaattaagagtgtttgagagaaaatagtgagggggagaacagcgaagtgaataagacgagacaagagcgatatgaatttatttacggaaatactgcgcggaaaatggaagcggcaccggcaaaacccgagtatgaaccatccaggcagccgaaaaggaaaccggcagtacgcaccaaaagaaagacaacacctcagacaaaagcaaaccaaacaaaagctctggaatttgattttgcgtttatcaaagcgctggcagcaggtatggctgtgatcgcactggtaagcttcttctatttgtcggagcagtcaaaactggagcagcagcggtccgcagtctctgccaagaaatcggagctcagcacactgctggtcgaaaatgaggatctgaatctggagatcgaacagagcattaatcttcctgcgatccaggaaacggccatgaagaaatacggaatgaagaaacctgcgcagagtaaggtaattgcatatgacagtaagaatgttgactatgtgagacagtacaataaaatacccgattcaaagtaaggagcggttttattgaaaaaaaagaaatataagaagatcaaaagaataaacaatgctatgagagtcaggactctgtctgtatcggctctcatagcaattctttttatttgccttatgggccggctggtttatttcagtgtggcaaaaaataagacatatgaaaaaaaagttctggcccagcagaattatcagagccagacccttccgtacaaaaggggagatatcctcgacagaaacggaaacacgctggctaccagccagaagttatacagtctggtcctggaaccgaaaaatatcctgcgtacagagcagactcagaaaaatgctttgaatgcactgaccaaatatatggaccttgaccgggatgatctgctgtcctatataaaagacaacaaagactcttattactcagtgtacaaaaaagacatgaagtacagtgaagtagcagatctgaaagattttctgaaatcgaaaaacggaaaaaaggttgtggggatcactttttctgaaaagtatgtgagaagatatcccaataagagtctggcaagccaccttctcgggttcgtatctgacggaagcattggaacaacggggatagagcagtattataacagtacactgtccggtgtggacggaagaaaatacacgtatctgaatgaggaactggaacaggatgactctattgtcgatccggaaaacggcaaaacacttgtgtctacgatcgacatcaatatccagaaaatagccgaagaccgcctggaaaagtttgaaaaaaaatacggcagtaagggaagctctattctggtcatggacccgaacaatggggaagtcctgggaatggccaactccaacaaatatgacctggaacaccccagagatgaaaaaggtctgctctcgaaatattctcagagccagatcaattccatgacagaaaaacagaaggtaaaagcctttaatgaactgtggaagaatccgatcgtatcaaacagtttcgagccgggatctacctataaaccgtttacggtggcaggaggactggaggacgggattctcaagggaaatgaacattattactgcagcggttacaaacaggtggggaaatacaagattcactgttctcacagagaaggacatggaaatctgagtctgtctgacagcatcgcatattcatgcaatgtggcgctgatggatattgcctttaaagaaggtaaggatgtatttgcaaaatatcaaaaagattttaactttggagtaaagacggggatcgatcttccgggcgaagcagaaaccgcaggccttctgcacggcgcagaccagatgacgaatgttgatctggctaccagttccttcggacagtcctttaactgttctatgatacaaatggcatcttctttcagttcattggtcaacggaggcagctactataagcctcatgtggtgaagcagaccagggatgacaaaggaaatgtagtgagcaacaaggaatccgaactggtcaaacagacgatctcggctgatacatccaagaagctgcgcacttatatggaagagacagtcgaaaaaggaaccgggaaaaaagcacagatcaaaggctacagcgtcggaggaaagacagggaccgcacagaaaattccgagaagtgcagggacttacatcgtctccttctgcggatttgctcccgtagaaaatcctaaagttgttgtatatgtggtcatagatgaaatccagaaagactcacagctcaacaccggactggctgttgaaatggcgagagatgtattaaaagaatcactgaaggacatgaatgtgcagaaaacgaaaaagtaaaacatgtcatacttgtttccttggattcatatatttttatcagtatggattccggagttttttatgaaaacaagttataaacgaaggatgcttctcatgggcggcatctttgcattctgtctgatctttatggcgggaaggcttggctatctgatgatcgggcaggcagataagtatctggcgctggccaaagacctgcaccagagagagcgggaaatcaaggctcccaggggaaatatttatgacagaaacggggtgaagatcgcatccaacaaagcggtttactctatctctgtgattcattcccagacaaagcagaaagagaaagtcgtatcggtcctttcaaaggaacttcagatagatgagtcagaaatcaaaaaaaaggtttataaaaattcagttagggaaaagattaagagtaatgtagataaagacgcagcagaccgtatcagaaaatatgaacttgccggcgttaaagtggatgaggattataaacggacttatccttataatgatctggcttcaaaagtcctgggatttacaggaggagacaatcaggggatcgttgggcttgaggtgacgtatgactcttatctgcagggcaaacccggaagaatcctgacactgacggacggcggcggaagagaaattgacggtgcctacgaggagagagatgaaccggtagccggcaatgacctgtatactacactggatgtgaacctgcagaactatgtgtggcaggcatgtgaaaaggtaaggaaagaaaagggagcaaaacgggtttccatgattatcatgaatcctcaaaacggagagatttatgccatggtcaacactcctgaatacaatttaaatgaaccgtttaaactgaaagggaaaaaagagaacaccacaggaaagaaaagacaggaactgctgaaccaaatgtggagaaacacatgtatcaatgatacatatgagccgggatctgtctttaagattgtgactgcaaccgccggtctggaacttggcaaagtgaaagtgacggatcacttcagctgtccgggattccggatcgtggaagaccggaagatccgctgccataaaaccacggggcacggcgccgagacctttaaggagggtgttatgaattcgtgcaacccggtttttatggaagttggagccagggtaggagtagacgggatgtatacgatatttcgccagatgggcctgtttgaaaagaccggcatcgatattccgggtgaggcaaattccattatgcataacaaaaagaatgtgggagcagtggagcttgccacgatgtctttcgggcagtccttccagattactcctctgcagctgatgagagctgccagtgccgcagttaacggaggaactctggtgacacctcattttggcatgaaggcagtggattcatcgggaaagacagtgaagacttttgaatttgcgaaaaagaaaaacgtgattaaaaaagaaacatctgagacaatgagggagcttttggaggcagtggtgtcagaaggttccggaaggaactgtaagatcgaaggatattccattggagggaagactgcgaccagtgaaaaactgccccgcggaacagggaaatatatttcctcatttttaggtttttcaaaggcagaacatccaaccgtgatggctttggtcatgatcgacgagccgaagggcacttattatggaggaaccatcgcagcgccggtggtacgggaggtatttaaagttgcacttccttatcttggaatttccaaggattatacggttgataaaacaaagaaataaagatatactggaaagataagaaaaacaaatgaggtgaaaacatgaattatagtatcgtaaaacctattttaattgcatttttcgtcagcgtggtgctgagcccgatgatgattaaatatttacagaagctgaaattcggccagttcatccggggcgagggacccgagtcccacctgaagaagtcagggaccccgacgatgggaggactgatcatcctgcttggcatcattgtggcttctctgttttatgtgaaagattatccgaacattataccggttctctttgttaccctcggattcggcttcatcggttttatcgatgattatatcaaagtcgtgatgaagagaaatcttggactcagggcctggcagaagatgcttggacagatcattgtgaccggagtgtttgcatactatctgatcaatcatacggatattggaacctccatgctgatccctttttcacacggaaaatatctggagctgggagcactgtttgttcccgctatctttattatcctgctgggaactgtcaatggggccaactttacggacggactcgacggtcttgcatccagtgtcactgttttgatcgctaccttttttacggttgtagccatcggagcgggtatctccggaaatgatccgggattatggcccatcacttgtgccacggtgggggctttgctcggatttctcgtgtttaatgtttaccctgcgagagtattcatgggggacacagggtcccttgcactgggcgggttcgtggctgccacagcggttatgctgaggctccctctgtttgtaccgcttgtggcttttatctacatgatcgaggtattgtcggttatgatacaggtcgtttattttaagaaaacagggaaaagagtttttaagatggcgccgatccatcatcattttgagctgtccggctggccggagacaaaagttgttgccatatttgccatcgtcacagcaatcttatgcctgatcggcctgatcgccatttagataaggagcaggaaatgacattaaaagataagaaggttttagttgcgggagcggggaaaagcggaataggatctgccagtctcctgatccgttccggggcatctgtcagtctgtatgacggaaatgaacacttgaaggcacaggatatttatgacaaactggagggaaaaaaagagattccgctgattcttggagaactcacaccgggagcagaggaggagtttgatctcttagtacttagcccgggaatttctgtcaatgctccggtatcaaagcagtttatggattccggcaggcctgtctggagtgagattgaactcgcgtatcaggtatccaggggacagattgcggctatcacaggcacgaatggaaagacaacgaccacagcgctggtgggagagatcatgaagtgtttttacagcgacgtgtatgtggttggaaatatcggaacaccgtatacgagcgttgctttggatacaaaagacgaaagcgtaattgtggccgagatcagcagttttcagctggaaacgatacaggacttccgtcctcaggtttcagcggttttaaatattacaccggaccatctggaccggcatgggacagtagaagtctatgcaaggacaaaggaatccattggaaaaaaccagaccggagatcaggttatggttctgaactatgaagacccagtgaccagaaatatggctgagagggcaaacgccagggtcgtatttttcagcctggatcatgaactggaagaaggagtctattttaaagacggatctttcatgcttgcagaaaacaaaacagtacagaccatatgtacagaagccgatatcaaccttctgggcgggcataattatgaaaatattttggcggcgatcgcggtatcccactatatgggggttccggcagagcagatcagaaagggagtttctggttttaaaggagtggaacaccgcatagaatatgtagataccattaaagatgttgcatactacaatgattctaagggaaccaacaccgacgcggccatcaaagggatcaaggccatgaaccgtcccacgttcctgatcgggggagggtacgataagaaggcagaatatgatgactggatcgaggcctttgacggcaaagtgaaggaactgatccttttgggcgcgacggcggagaagatcggtaaaacagccgaagcccacggtttttcccgaattgtatatgtagatactctggaagaagcagtggagtatgcatcaaagcatgcagtttccggcgatgcagttcttttatctccggcctgcgcaagctgggggatgttcccgaactatgaggtacggggcgaccgcttcaaggagtatgtaaacaaattaaaggagcgctaagatttgaaaaaaagcagagtcagtgaaaaatacatgccaaagcggcgttatctcgattatccgatgctttttatcgtgatgtttctcgtgggattcggcctggttatgatctttagtacaagttcatataagagtacactgaactttgggaatccgtatcactggctcatcaggcagtgttttgcagttggagtgggagcggtctttatggcagcactcacatggtttgactacaggattctcaatgcaaagatcattgcctatggctgctatggcctcagcgtggcactgctgatcatcgtattatttatcggtgccgctaaaaaaggagctgtgcgctggatctccatcggaggattccagttccagccttccgaagtcgcaaaaattttccttgtgatctatctggcatacatattatcacagaatgcccatcggatgcgtacgatggctgctgctgtaaaagttatcatccgatgtctgccgatcatcggactggttgcctatcagaacttaagtacggcgatcgttttgacggcaatggtcggggtcatgatttttgtggtaagtccgaaaaccaaagagcttctgggaattgccctttcaggtgtcgcaggattagtgctttatctgacgttttccaacagttaccggaacgaacgtgtggcgatatggaaaaatccggagactcacccgaaaggacttcagaccatgcaggcactgtatgccatcggttccggaggcctgtttgggaagggccttggccagagcatgcagaagatggggttcataccggaattccacaatgatatgatcttctcgatcatttgtgaggagctgggcttattcggagctgtctgtctgatccttctgtttatgcttttaatatggagaatgcttttgatcgctatgaattcggatgatctgttcgggtccctgatcgtgatcggatttatgattcatatcggagtgcaggtatttataaacatagcggttgtaacaaatacgatccctccgaccggtatccctctgccgtttataagttacggcggaacttcaatcctggtcgttatggcggagatggggctggttttatcggtatccaggaaaatacgcatgtagaggaactgattatggataaaaatgaaaaaataattacaatcaatcaggcaaaaaaacagcagaagggccctgggaataagaaaaaaattatcggctgcattgccggcctgctgtttcttctctgtattattttatttgcagtattccagacgaaaaagattgtcataaaagggaacagccattacacagagggtgagatagcggccgcactgaaggacaatacatacacgggcaacgggctgatcctgtttctgagaaataagattgcgcctgtaaagacgcttccgttcgtagactctgtaacgataactcttaaggggacggatcaggtgacggtgcaggtcaatgagaaaaaacgggcagggtgtctgaactataacgggaaatatgtttatttcgataaggaaggctatgcgctggaaatttatgagaaacactatgatgatgtgccgctggtcacagggctgaattataaaaaaattgctctcggtgaaaaaataccggagaagaagactgccgtatttgagcagatactaaaaattaccatggccatcgacaagtatgatcttccggtaagccagatccattttaatgcagaagggaaagcccttctgatcagcggagatttaacgattaatctgtggaacagccgggagctggacttgaagcttacagagcttacaggtatccttcctaagatgaaaggcaagaagggtaccatctcgatgaaatattttacaaaggacaatccggtagcgattttcaagaagaaaaagtagttgaaagtttaactgaaaaactgtatcatgtaagaagataacatgaaatgataatgtggatgagtataagaaaatttgagatagagattgaaggaggagcatcgtggtcgagattatgccgaatgtagaaagcacacaagccagaattttagtcattggagtcgggggagccggcaacaatgcagtgaaccgcatggttgacgaaaatatacagggagtggaacttgtaggaattaacacggacaggcaggccctgtctttatgcaagtgctctacgaagatccagataggagaaaagctgaccaaaggtctcggtgccggtgcgaaacctgagatcggagaggcagcggtggaagaaaaccgggatgagatcacacagctggtacagggtgccgatatggtctttgtcacctgcggtatgggaggcggaacaggtaccggagcagcaccggtgattgccgagatttcaaagtctcttggtattttgaccgtcggtgttgtcacaaagccttttacttttgaaggaaagccaagaatgaacaatgctgtcgcgggagtggcgcgtcttcaggatcaggtggacacgatgatcgtgattccgaatgacaagctgcttcagatctgcgagaagaaaacaaccattccggacgcactcaaaaaagctgatgaagtgcttcagcagggtgttcagggaattaccgatatgatctacaatcctggtcttatcaatgttgactttgcagacatccagacggttatgcgcgataagggtattgcacacatcggtatgggtgttgcggatgaggaattggaagcaatcaaggcagccatggaaagcccgcttctggaaactacagtttccggagcgaccgatatcatcgtcaatttctcaggtgatgtgggtatgctggaggcacagcaggcagtagagtacttgaaggatacggctggacaagaagtcaacgttatcttcggcactgtcaactctgatatgggtgaccagatcagcgcaactatcgttgccacggggatccagtctgaggcaggagccagaggagcaggatttaagaagaaaagcattactcctcctcccgttttttccggacagcctatctacagcagtcagccgaaaagtgagcctgctgaaacagcagaatctacatatgggagcaaagaacaggagactgccagtgtagaggatcatgattcaaagatcgtgattccggagtttttattaaagagcagaagaaaataaaataaacgtgggacaagcccgtatcttgccgtaaggcaggatacgggtttttttgtagaattaacgtatctgccacttctcttttttgacaaagtacgtgcacctctttttttataataagcttatgttttttttgatgatgtttttggaacagtggctggtcctcctggggctgctgcttattttaagaagttcgctgaaatcacagagttctgtctggcgtatcctgctggcatcagcggccggaagcggactcgggtgtctgacggcatgggcggcggaaggaaatcaggcagtccagcttggatttctcgcggcaagcatcggagcgacctcctggcttgcatttccgctctctctgagaaaaagtctgatatgttccggatatttatttgcactctcagccttgctgggcggactgtggagcttcgtgaaataccgtttatctatccatatctggattttcggctgttttgcggcgtttctcctcttggcttttttgtattgtgcagtctgggaaaatatcaggagccagaaagattccttataccaggtatcatttgaactccttggcaggacggtcagagtcactgcctatttggatacggggaattttttatacgaacctatagaaaagatcccggtttccgtcatggaggaacaggcactgaatccatatttagatgaatcattaaccattttaatagaaaaacataagctaaaagatataagaatgattccatacaggacggttggcagggaaaacggcctgatgatggggattcttgtagctaatatcagaatcaagaatagcagccagacatggatggcagaaagaggattgataggactgtcagagcacccgctttcccgggacggccactatcagttactgctccatccggatctggtcagataaagtaatgggaggttgtacagtgctgaaacttaatgtgacatgccaaaagaggacttttttagcgaaaggaaaagaaatccactacatagggggtgcagaaattctgccggctcctctggaagcaaaggaagaggagaagatgatacataagctcgggacagcggaggagccggaagccagggcaaaattaattgagcggaatctgcggcttgtagtctacatagcaaagaaatttgacaatacagggatcggtgttgaagatttaatatccattgggacgattggactgatcaaagccatcaatacatttaatccggccaaaaagatcaaacttgctacctacgcttccagatgcattgagaatgaaattctgatgtatttgagaagaaataacaagacgaagatggaagtgtccatcgatgaaccgctgaatgtggattgggacggaaatgaacttctgctctcggatatactcggaacagacgaagacattatttacagggacctggagcatgaggtggacaggaagcttttgctgaatgccatgaagatcctctctgaccgggagagaaagatcattgagctgagattcggcatcaaccagaaggatggggaggagaaaacacagaaagaggttgccgatttaatgggaatctcccagtcgtacatatccagattggaaaagaagattattaaaagattaaagagagagatgtcccggatggggtgtgtctgatcagtgaaaaagagaatgccgcatgggagaagtcctgatgcggctttttcatttcatagaaaagttctacgaccttctctatgaaatacaaaatctccgagggctgtccacagatgcgtaaggaaaactttgttttacatgaagactcatggaaaaattttctgtgtgattgggttttgaaaatgagcggaatgatgttatactactgacatagaaaaaggaggagacaagtgagagtaaaaggggtaaagaataaacttgcagtatttatttcagcaatcgtattggctgctggaatttcttacatcaaccatgcttctgtttttgcggaagaaaaaagtgcggaagaacatgatccggccaacagttggcggtttaaagatggaaaaccggtaaaacagcaggagccgataggtccatctatgacggccagaggagccagagcggtagctaatgcttggacaaaagtaaatggagtattcctaaattctctgggtgaccctattccaaatgcaactgcaaggggcattgatgtaagcaaatggaatgaaaaagttgattgggaaaaagttaaggcagatggagtggattatgcaattttaaaaataggatccagaaagaattcaacggatcgggatgatcctacttgggcatataattcatctgaatgtgaacggattggaatgccttacggggcttatatttactcttacgcaacgagtataacagatgccaaaaaagaagcagaatatgtaatacgatgcataaaggggaaaaagctatgttatccgatatattacgatatggaagataatgttcaggaaggattgtccaacaaaattctcgggcagatcgcggttacttttataaatacattatcggatgctggatataaggatgtaggggtatatgctaataagtattggtttactgagaagcttacaagtactgtctttaatgagtatccaagatgggttgcacagtacaattaccactgtaattatagcggaacttatcatatgtggcagtgtacagattctggaaaggtcagcggaatcggtacgaatgtagatctgaattttaaaataggctcatggaacgtcaatgcactgcagacgatatctgtttcgtcaataaagctgaataagacaagcctgaagcttaagaacggttcttcctatacattgaaaaaatcaatcgcgccatccaatgcttccaacaaaacggtgacatggaccagttccaataaaaaagtggcagctgtttcttccaggggaaagatcactgcaaagggcgtggggaaagcaacgatcacagcgaagacatccaacgggaaaaaggcagtctgcaaggttacggtacggcccaggacgaacaaaattaaaaagcttaaaaaatcgggaaggaaaagcattaaggttacctggtcaaaagttagcggtactacaaaatatcagatttatatgtcaaaaaagaaatcttccggatataaaagggtaaaaactgcatcagctaaaacattcagttttaccaaaaaaggactgaagagaggcaaacgttactattttaaaatacgttcttataaaacagttggaaaaaccaagtattacagcagctacagtccaatcaaatcaataaaaagataggaataaaaagcaataaaaaagatcctgaacaggatcttttttattgcttttgaatatcgaaactaaagaatgatttatttaatggtgacggtgttatcgtatctctgataagtatagtttttagatttatatttgtagataatcgtcaggcggtccgggctgatgtataaatactggactttactaaagtcaatgtcacttcccaaataatgcatgaaggaatccttaaaatcggtatctatggtggtaccctgctcatggctccagccggctcccgaagaatagattacttcaccatttttactgttgttgtcagcataaacctccgcataggcagaagtagcagcgtttgcgatcagctttaaatccgcatgggccgagcgtttgttggctctgtctatgtacccggtcagagtcggcaccagcaaagcgatcaggatcgccagaataaccagcacgacgattaattcaactaaagtaaatccttttttgttccctcttaaacgattcatataaaccccatcctttgtcgtttgttttttttaattatatcacaggagaatgaaaatttatacccacaggcggacaacttgtgatataatagtcctacaaatgtaggattatcgaaaggggacagggatgaagaaaagttttttaagagcggcaaagaaagttttcgcggtacttttgactgtcagtttgatgtcggctgcactgccggtactcgtaaacggtaaccaatcagaacctaaacagaaggaaggacagggagcagagaacagctggcgttacaaaaacggtacaccgatctatcccggacagtctttcagcagagcttcaaaaccatattcaaatgcctggaataaagtcaacggcatgtttgtcaatgatctggggaatccgattccgggcgcagtgaaaaaggggatagatgtcagtcagcatcagggaaagattgactgggagatggtgaaagcatcagggattgattttgctgttatccggtgcgcaaacagcacatatgacgaagatactcagtggcaatataatgtaaaagagtgtgaacgattgggtattccatatggagtatatatcttttctcaggcaaaaaacacggctcaagctcaggcagaagcaagatttactttaaaattattaaccggacataaaccgaattatcctatatacatggatctggaagctaattcgatcagtaatctgtcaaagaatcaatatagtaaaaatgcagaggcatttaaggctgttttaaagacagccggatattctaacataggtatttacgctaatacaagctggtggaaagaaaaattgacaagttctgcatttaataaatattccaagtgggttgcccagtgggcaagcaaatgcacttatacaggcagctatcagatgtggcagtgcaccgacagaggcatagtcagcggcatcagaggaaatgtggatataaactttctgatcagcagcattccggcaaaaaacatcaaactgaataaaaaatccctgtcgctgaagaaaggttcctcctatacactgagaagttacatagaacctaggaactcatatccttcagttcagtggtccagctccagttcgtctgtggcatcggtcagttcgtcaggcaaagtgacggcgaaaaaggtagggacagcggttatcaccggaagaacaggaaacggaaaaaaggcttcctgcaaaattacggtgatcccaaagacgaataaaataaagaagctgaagaagagcggatcaaaggggattaaaataagctggtcaaaaatttccggcgtgtctaaatatcagatttacatgtccaggaaaaagtcttccggttttaaaaggatagcaactgtatctgcaaaaaaagcatcttacacaaaaggcaagttaaaaaagaaaaaaaggtactattttaaagtcagatcgtatcagactgtaaagaaaaagaaaatttacagtaaattttctaaagtaaaatctcttaagcggtgatctaaagatattcctcttgtaaaagtggcttctttagtgtagattagccttacagtcattaaacatcaggaggataaagatatgattattgcattgatcgcacatgacaagaaaaaagacgagatggtggaatttgcaaagaagcataaagaaacattagcaaaatatgacttggtcgcaaccggtacaaccggaaaacgggtagaggaagccacaggacttccggtgaagaaatatttgtcaggaccgtatggaggagaccagcagctgggaggcagaattgcagagggaaagatcggactggttgtttttttccgggacccactgactgcacagccccatgagccggacgtgtctgcactgcttcgtgtctgtgatgtgcacaaggtaccggcagtcaccaacactgcggcggcagaactgatgattcaaatgttttaaactgtcaggactgagtattttgacttgaaaaatgacagatcatagtgtatatttattttgaaagctgtgcgactggcggatagtggagaaaccacggggagcacggcagcagaaatgccggccgcctgggcaacttttatttagtgtgcccaggcggcttatttttacataaaaaaggtctgcgaacctttcgtatggaataaaaatctctctgcgaagctgcacacagatacaaaaggaggatacaggacaatgaagatgttgtcattagaaaacgagttaaaagggaattcataccctggaagaggaattgtgatcgggaagtcaccaaacggggcctatgcagtgactgcatattttatcatgggaagaagcgaaaacagcagaaaccgtgtgtttattgaggacggaaaaggtatccggacacaggcttttgatccgtcaaagctgagtgatccgagccttatcatctatgctccggtcaaggtattaggaaataaaacaatcgtgaccaacggagaccagacggatacgatctacgagctcatggataaacagcagacatttgaacaggcattgaggacgagagagtttgagccggatgcaccgaattatactccgcgtatttcaggcattatgcatgtggaaaacggaacctacaactatgcaatgtctattttaaagagcaataacggtaatccggatgcatgtaaccggtatacatttgcctatgagaatccggtaagcggggagggacatttcattcatacctatatgcaggacggagatccgcttccgagttttgagggagagcctaaattaatcggcttagacgatgatattgatgcgtttacaagccgtgtgtgggaaagcctgaatgaagacaacaaagtatctctgtttgtgcgctacattgatatcaaaacaggagaatatgaaacaaggatcgtgaacaagaatcaataggaggagaccatgaaggaattagaattaaaatacggatgcaatccgaatcagaagccgtcaagaatttacatggaagacggtgaactgccgatcaaagtgttaagcggcaaaccgggatatattaattttctagatgcattaaacggatggcagctggtgaaggaactaaaaaaagcgaccgggcttccggcggcagcttcctttaagcacgtctctcctgcaggcgctgcggtagggcttccgatgactgatgtggaaaagaagatttactgggtagatgacatggatatggaatttactcctcttgccaatgcatatgccagggcgaggggggctgaccgtatgtcttccttcggagatttcatttcactttccgatgtgtgtgatgcggcaacagccaaaattataaaaagagaggtgtctgacggggttatcgcaccgggatatgacgcagacgctcttgaaattttaaaagaaaagaaaaaaggaaactataacgtgatcgagattgatccggattatgtgccggctccggtagagcgcaaggaagtgttcggtgttacttttgagcagggcagaaatgaactgaacattgacaaggatttctttaacgatatcgtgacagagaataaggaactgcctgactctgctaaaattgacctggcgattgcaatgatcacattaaagtatacccagtctaattccgtatgctacgcaaagggcggacaggccatcggcatcggtgcgggacagcagtccagaatccactgtacccgtctggcaggacagaaagcggacaactggtatctgcgccaggctccgaaagtcatgggacttgagttcgtggacggtatccgacgtgcggaccgtgacaatgccattgacttgtatatcggagacgactatatggatgttttagccgacggggcttgggaaaatatctttaaagtaaaaccggaagtgtttacgagagaagaaaagcgtgaatggctggatcagatgacgggtgtggcattgggatcagatgcgtttttcccgtttggcgataatatcgaaagggcacacaaaagcggcgtttcttatgtggctgagccgggaggctccatcagagatgaccatgtcattgccacatgcaataaatataacatggtgatgtgttttacgggaatccgtttattccatcattagaagatataagaaggagagaaatcaagcaggtttctctccttctgtattatagggtctggcagtaaatatgaatggcctttgagacgaagcgggcggttccctctccgccggcacggtctatagactctttcatcctgtcatcacagacgtacatttcgcccagagaggccagaatatcgtctgtacaggtataatattgatccgtaatagactgtttgaggagctcaacctggtgcatcaccggttcggaggccgggtcttcgtttatgagacggccaaattccgcaaagtttgccataaacttggtattcatgaccttccagtcctcctctgtataagtttttgctttctgctcatattcacggaaagcatcggtaccgccccagctttttctggcctcggatttatagctttccagcgtttctttgttcaatgtctgataattcaatgattccactcctaacttttgaattccaagagcgaagtcgatcagatgttccagccggtcctttttaagcctcaaaagctgtatctgctgatctaatgctttttggcggtcaaaatccggacggtccaggatctctctgatgtcctttaaagagaattcaagttcccggaacagtaaaatatgttgaaggcgttccaaagctttggtgccgtacagccggtagccagcctccgtgacacggtcgggacataaaagtccgatctcgtcataatagtggagagtgcgcacactgataccggttaatctgcttacttctcttactgttttcatcttggtctcctcctcctggtaagtacagaatagcctatcacgctgcgtgagagtcaagagataaaatagattaaaggaattctgtcatgtgtttgcggtaccagagcggcatcatggttctctgacagcggggattttttctggcttctacaccgatcgtctcaaaaaatactttccagagatctgtgtaaagatcagaaatctcagaggtcttcagacggtttaattcatcctctgagagggtggtcatatagtaatcatgatcacagggatgaacgacggcagttttccggttatcgtcgatgatcatccagttctctgagggcatgcggtccgtaaactggggagccaggatggtcaggacatcacacttgggttcaatatgggagataagaacatgatctatttcgaaaaaacgcagaaactcccggaataagtgagcttcattcataactttacggtccagttcaaacagattcatcacagcaggctcctgcagcatattgacaacggaaggcccatagtgaaacccatagatcaggaaccggtagatgatatccagtttttcttcctgaaaagacatagcagcgcggtataccatctgataggcacgaaaagagatctttttttggatggaacggatgacactggcggtctgatcgggatcgtgatctacatggcggtaatcacagaacagttccagattccctatgggttcagtttttaattggatgtttttgtggcctaagcgggatgcccaggcagtgtatatacaggacatcatatcctcaaacgtatctttgcaggtgaaaatggtcatgcgttttctccattattttcagtcggccgtttttcaggcaaatattaaaactgttactgttttttatatttgtccgctcagagacttgcaggtatcttcggctgagggggccgatacaaaattcttatcgtcaaacagggacagctgttcataggtctggggatgatcaatctcccaggactttttgtaatcctctccgatcagctgacgggtgatgaagttctcctcgatcgggatatgaaacatcatctttccgttacaggttataaaatacttggcccgtttcaggacgatccccatctttttcaggttttcaaatgtcagggagcgctgtcggcggctcttgacaatacggtaggcggatttggtgccgatgccgggaactctcagaagatctgcgtagctggcgcggttgatctccacagggaaaagctccaggtgccgcagtgcccagtcgcacttggggtccagcatgatattgaagttgggcctgtcagtactcagcagttcctctgcatgaaagccgtaaaacctcagcagccagtcggcctgatagagacgatgttcccttaacagaggaggggcggtatccagggagggaaggcgggaatcttcattgagcgggacataggctgagaagaagacacgtttcagatcaaacttctggtacagctgctgagtgacagaaagaagctgaagatcattctctgcggtagctccaacgatcatctgagtgctctgcccggcggggacaaagggtgcattcttgtccttagcgggcgggaggaaagagtttgatgccagctgtctgtgctccccgatgcggccggatcggacatcatcgaagatcgtgtgctttagactgcggttgccgccgaagcgttccatcatagggtccttgccgatggacagccggtgatctgcgatgccggaacggatctgttccatgggttttaagatcgttttctgtgtcttgtgaggggccagatccttcagtccttccggtgtgggcagttccagattaatgctgacgcggtccgcgagatatccgatggattccagaagttcttccggcgctccgggaatggctttcacatggatatagccgttgaaatgatactgatttcttaacatagacagtgtccggcacatgagttccatcgtataggaaggactctttaccacaccggaacttagaaacagcccttcgatatagtttcggcggtagaactcgatgactaagcggcagacttcttccggggtgaacgtagtgcgcacccggtcattggacgagcggtttaagcagtacctgcagtcgtagatacattcattactttgaagtatctttaaaagggagacacagcggccgtcggatgcaaagctgtggcagatgcctgcagccactccgttgcccagttttcccttttcacctctgcggtcggctccactggacgtgcaggctacgtcgtacttggctgcgtctgctagaattgttagcttctcctgcaatgacagggaaggactgatagtttccataatccacctcacaatatcgaatgtttgttctcttattctagcatagtgccatataaaaagcaaggaggaaaagaacaaaagttcgggtgaaaagaagttgcggcaatgtattggtaaatggtattattatacttaacggaaaaacaattcagaaggatgagggtttgtatgaatcaaaaaaataaaacgaagctcggcaaggcagcgttgttcggttctgcactgatatggggcagttccttttttattatgaaaaataccattgccaatgtcccggaaaattttctgcttgggacaagatttttagcaggggcattgctcttgtgtatcttttttcataagagactggggaaaatagataaaagttactttaagacaggatttgtgctgggaggattttggttctgggcttactggttccagaccgaaggactgtatcacacgacgcccggaaagaatgcatttttaacggcgatctactgtgtggcagtcccttttgtcacatggatatggcaaaagaagaagcctacaaagcaaaacttcctggccgcattgatctgcattacgggtattggactgatttcactggatgggaaccttagtataggaatcggtgatggattgactctggtgggaggccttttattttcccttcatattgcctatcttggcatgaaaagcggtcagaaagatccggtgctgctgacgatcgtgcaatttttatttgctggactctggggtgcagggatttctgtatttaccgaagacatcagtgctatccactggacggtcggacaggcaggaagcctggcctatctggtgatcatgtgtacggctgtggctgttacctttcagagtatagggcagagccgggtgagttcatcttccgcatctctgatcctgagtctggagtccgtgttcggtgtgcttttcagcgtgattttttatggtgagaaggcgacggtgaagatcctgatcggttttgccctggtgatggcggcgattttgatctcggagacggatttgggcagaaagtccgggcacaccgaaaataatgataaaaaacgcattaataagaaaacagcaaatgtggtataatttatcatgaacagtgaaatattttccgcctgtgtacacggcggatcaagtataaaataaagaacgaatttcggaggctatgatgaagaattatgaattggtaaaagaagaacagattaaagaactgaatggaaccgggtatgtgtaccgccacaaaaagacaggggccagggttgtggtagtatccaacgaagatgacaacaaggtattccagattggatttaagacaccgccgaaggatgacaccggagttcctcatatcatggaacactctgtactctgcggttccagggagtttccattaaaagacccgtttgtggaactggtcaaagggtccctgaacacatttttgaatgcaatgacctatccggataagacggtatatccggtggcaagctgcaatgacaaagacttttttaatctgatgcatgtgtatttagatgcggtattttacccgaatatctatacgaaacccgaaatcttaaaacaggagggatggcatcactctcttgaatcagaagatgcgcccgtaatctacaacggcgtcgtttacaacgaaatgaagggtgtgttctcatccccggaccagcagctggcgcgtctgatccagaagtccctgctctcagacactccgtatggatttgaatccggaggcgacccggaagcgatcccggaactcagctatgagcagtttttggatttccacaggacttactatcatccgtccaacagctatatttatttatacggagatatggatgcggaaaagtacctgacattcatagacgaacattatctgtctgattttgaaaagaagcaggtggacacatcctggaagccccaggaagcctttaaagaagtaaagagagtggaggcagtatatccggtcagcgagcaggatgagatacagaacaaaacgtttctctcctataatgcagtgatagggacaagtcttgataaagaactgtatatcgcatttcagattcttgacagggcactgttctctatgcagggcgcgccggtgaaaaaggctctgatggaagccgggatcggcaaggacatcagcagttcctatgacaatgggatcgaacagcctgtgttttccgtggtggcccaagaggcagatgaggaaaaagaggcagactttgtgcgcatcatcgaggacaccctgcgtaagatttctaaagaggggattcagagacgaagcctggaatctgcactgaattattatgagttccagtataaagaggctaatttcggcagatttccaaagggactgatgtatggacttcagatgtatgacagctggctctatgacgatcatgagccgttcatgcatatcaagaccaacgatgtgtttgagtttttgagaaaacagctggacggaagttattttacggatttgattgaaacttatcttctgtccaatacacataaatccattgtggtgctgaagccggagaggggccttcagagccggaaggatcaagaaactgcgcagaagctgagagaatataaagaaagtctttcaaaagaagagatcggtaagctcgttcaggctacaaaagagctgaaagaatatcaggaggcggcaactccgaaagaggaccttgaaaagatcccgcttctggatattaaggatatcaagaaggagatccggcctctttgcaatgaagaagtatcagtggacggagttaaggtgatctggcatccatattttacaaatggtatctgctatctgaagatcgtattcgacatgtcagaggttccggcaaggctcgtgccttatgtgtctctcatgtcagaagtattccgaagcgtagatactaagaagcacagctactttgagcttggaaatgaaatcggtattgagaccggaggcatggtgacgacgatggacgttctgccggccggtgctgaaggtgtaaaaagttattttgtcatcaggacaaagtgtttttatgaaaatgcaaaaaaggcatttgaactcatggaagagatcctgtttgagagcaaactggaggacaagaaacgtctgaaagagatcatcgggcagatttacactaatatgaagacagatcttacacaagccggacacaaaacggcatccaaccgcgccatgtcctatttttctccttatgcaaggtataaagaacagatccagggcgtttccatgtttgagtttgtaaaggactggtatgaatcctttgagcaggagagcggaaagatcattgacagcatgaaagaggcgtgcagatatattttccggaaggaacatatgatggtgagttacacaggaaaagaaaaagaaccgtcctttatggaagatgcgttgcacaagttctcagcacgcatgtttaccggcgaattagccaaagaggagacaaaaattcttccggagaaaaaggaggaaggcttcgctacggcgggcggtgtccagtatgtggcctgtgcaggaaattttgctgagcagggttatgaatatacgggagccttaaatgttctccaggtaatcttttcttacgagtatctctggcttaatatccgtgtaaaaggcggagcctacggatgcatgtgcagctttatgcctcagggagacagtatgtttgtatcctatcgggacccgaatctcttagagacttaccaagtctacgaaaatgcggctgattttgtggagcatttcgatatcgatgaccgtgacatggtaaaatatatcatcggaacgatcagcaatatggataccccgctggagccggatgatctgggagagagaagcttccaggcttatcttcttggaaggacagaagaagaacttcagaagtacagagaccaggtgctgtcctgcagtcaggagacgatccgttcgctggcaccgtatgtgcgctgtgtggtggatgcggggaataattgtactatcggaaatgaagataaactgagagaagctgaggataaatttaaagaaatcaaacacgtattttaggaaggaattttatgaacacaggaatgaaatcgggatttgtgacattgatcggcaggccaaatgtggggaaatctacgctgatgaaccagctgattggacaaaagatcgcgatcacctcgaaaaaaccccagacaaccaggaacagaatccagaccgtattcaccgacgacaggggacagattgtatttttggacactccggggatcaacagggcaaagaacaagctcggcgactatatgctgaaagtcgccgagaggactcttaacgaggtggatcttattttatggctggtggagccgactacctttatcggaggcggagagcgctatatcatcgaacagctgggcaaggtgaagaccccggttatcctggtgatcaacaagacggacacggtgaaggacgaagagatcttaaaagcgatcaccacctacaaagatgtatgtgaatttgcagagatcataccggtttccgcgctgaagggacagaacacggatgatgtcacagacagcattttcaaataccttccggaggggccgatgttttttgatgaagatacagtcacggaccagccggagcggcagatctgcgcggagctgatcagagagaaggcgctgcgtcttctggatcaggaaattccgcatgggattgcggtagtcatcgactccatgaaagagagaagacacggccatatcatcgatattgatgcgatgatcgtgtgcgagagagactctcataaaggaatcatcatcggaaaacagggcagtatgttaaagaagatcggaagccaggcccggatggagatggaaaaccttctggatatcaaagtgaatcttcagctgtgggtgaaagtgaaaaaggactggcgtgacagtgacatgcttctcaaaaattacgggtacaacaagaaagaagtataaaaaatgggtcaggagatcaaagtaaccggtctggtactgaacgccggaaatatcggagaatttgataagagagtcacgcttctcacaaaggaacgaggaaggatcacggcgtttgcgagaggggcgaaaaaagccaccagtccatatgccgcggcctgtcagcctctgacattcggagagttttcactgtatgaaggaagaagctcctttaatctcatgtgggcagatgtaggccattattttgagggcgtcaaggaagatcttcttttggtttcctatggcagttatttttgtgaatttgcatcttatcttacaagagaaaacaatgatgaaaaagagattctgaagcttctttacctgagtcttagagcacttgaaaaaaagaccatagatccgaagctcatacgcagagtgtttgaaattaaactcatggctctctacggacagggaatggaagtcttttgctgtacacagtgcggcagcacagaggacctcagctgttttgacagcagtgcgggagggattctctgctcaaactgcagaaaatccggaggaagagcggtacatatatccggatctgcggtatatacgcttcagtttattttaagcagtcccccggagaagctgtatacgttcagggtttctaaggaagttttgaaggaacttgattctgtcagcgagtcatttttaaaacagtatgtcagccatcatttcaagtctctggattttttggaactgctttgacttttttagcttatctcttgaaaaaagaggggttacacgctacaatagaacagattataggaaatgaagaaacggtgaggtagaaacaatatggaattaacaatggagaaaatcgtaaatttagcaaaagccagaggttttgtgtacagcggatctgagatttacggcggattggcaaatacatgggattatggaaatcttggcgtggagcttaaaaacaatgtaaaaaaagcatggtggaagaaatttattcaggaaagcccgtataatgtaggtgtggactgtgcgatacttatgaatccgcagacctgggttgcttccggacatctgggcgggttttccgaccctttgatggactgtaaagagtgccacgaacgtttccgcgcagataagatcatcgaagattatatggatgaacacggcatggagattgagggcggctctgtggacggatggaccaaagaagagatggtggattttatcaatgatcatgacatcgtatgcccgtcctgcggaaagaaaaattttacggatatccgtgagttcaacctgatgttcaagacattccagggtgtgacagaagatgcgaaaaatacagtttacctgcggccggaaacagctcagggtattttcgtcaactttaaaaatgtgcagaggacatccaggaagaagatcccgttcggtatcggacaggtcggaaaatctttcagaaacgagatcactcctggaaactttacgttccgtacaagagagtttgagcagatggagctggaatttttctgtgagccggatacagaccttgagtggtttgcttactggaaagatttctgtatcaactggttaaagacactgggcatcaccgatgaccagatgagagtccgtgaccatggaaaagaagaactgtctttctactccaaggcaacttcagatatcgagtttttattcccattcggatggggagagctgtggggaattgctgaccgtacagactatgacctgacacagcatcagaatacttcaggggaagatctgacttactttgacgatgaaaagaaagagcgctacattccatatgtaatcgagccgtctcttggagccgaccgtgtgacccttgcgttcttatgtgccgcttatgatgaagaagaactggaaggcggagacaaacgtaccgttcttcgtttccatccggctatcgcaccggtgaagatcggggtgcttcctctgtccaagaaattagctgagggggcagggaaagtttatgagacgcttgcgaaatactacaactgtgagtacgatgagcgcggaaatatcggaaagagatacagaagacaggacgagatcggaacaccgttctgtgtgacatacgatttcgattctgaagaagacggagcagtaaccgtcagagaccgtgatacaatggaacaggaacgggtgaagatcgaagatctgaaagaatactttgagaagaaatttgactattaaaaactatcaaataattggaccggcgggatttgttatccagccggtttttctattctgtcaatatggattctgcacgatcatgcaggaatcaacttacatggatttttgatacgccagacgttcactgccgtcgttcagacagatgatcccacagtatgagaaaccattttttttgagcagattctgcatgaccttgttgtcacggtgggtatcgatctttaaatttccgcactgttccagagcccaggaaagacaaaaagaagcgcatcctttctgtgttgttttggaagcaagtctgtgtacaacaccgtaagggctttcatttctccatttaccgtcataaatttttttataagaaaaatcttgccccattttataaaaaaagacagcttgtatttgttcgttttctatgcatacataactatttccagcttctatatccatgcggatcatggactcttccggataatgttctccacattgatccgggtttccgtgctgtttcataaatagcctggcaccagaatagagagccatgatttcattcagctgttcgattctggatttctggattttcatcatagattcctttccctttaaaaagtaataaatttggttttgtgtatcttttgatgcagacaaatcatggggatgaatttataattctagatacagtccggccggttcaaagagtttccagcgaacagtattccgttagtgcaggcagatccctgatctctatctgtttccggcgggtgagaataatttcctgctcccggagctgtgaaagaccgcgggttacatggatacgactgattccaagaagatcggaaagatcatcctgcgtcatgtcgatgtacagatccggatgatccgtctcgtttcctgtgagcaggtaaagcagattgcacaggcgggttaaggaactgttgtattcctgatgtgctgtttcatagagcagacgatttacatacgtggaataccaatctacaatattggcgctcagctgaggatttgtctcaaacatctgccggaattgctcttttgtaaattccagaacgttcatatccgaaacggctgtagttatgagagattgttcaattttatagtcatgctggtgataaccagggaacacggtaccctccccgtggaaggatataattttcctgtggccgttttcgtgttccatatagttttgggcagcgcctgagattatgtaatgaattctttggaagggttcgccgctctcccacagaaattcaccctttcgaaagaaacgttttttatgaggctgagtgagaaagtaactgtaaaactgtttgaaatcattggcaaaaaagtaccgaggggtaagcatacgaagacctccttttgctcaaagtggtttttttattttaacacttttttgctaatgtatcaaaaatgattgatgagtcaaaaggaaggagattaaaaaatgaaaaaagtaaaaattacagtcctgagaaccatgtttaatgaggacctggctgccgagtacggtacagaagggcttgcagcatgtccttttcacagggagggtcaagtgttttacgccgactatgcaaaaccggaaggactctgcgatgaggcatggaaggctatttaccagtatgtatttgcactggcccatggagcgggaaatgaagtgttctattacggagactggatcagaaagccgggcactgccatatgcagctgcaatgacgggctgcgcccggtaatctttaagctggagacgacacaagaggaagagtgacattttccacatgatttccgttcggctcttagaatgcctcactctaatcatgtggaaaatggacataaattttataggagaagcatccatcgaacaaagggggctatccaacgattgttttctattcttcttttattttggcgatctctttagccatttttttcttcatagtgagattactctggcgtgcgatcatgatccgctgtgcctgcggtgacccggcaccgtgcatggattctgtacggtatccgacggctgcgcttccaagagtcagattttcaatcagcctcatgatgcgaagtctgttttctgtggagacgcctgacactccgtggagatacttttcaacataagcgcccagcttcggatctttcagatctttttcggaaggagcggtaaccatcagacctcctgcgatatcttctgcaagacgtgcgatttcatatggaaagcgggtaacattctgtttacatacattggccagaagcagatcgatcagatagtttccggatctggtggccgcaccttcggcagaacatgcgatgccgcagcagtacagggtttcgtttaaatgggtcatttcgatcagcttgtcttttacatgggaggcacgtcccgctccattgtattctgctgcagctgcagacgcaccgatcaggacatcaccaacaccaactttacatccgccgtaggactgtctgtggtatccggcaaaacgctccaccagaaccccggcaaaatcatattccccatttaagaaaatacggtcgtttggcacaaagacattatcaaacacaaccagagcttccattcctccgtattcggaatttcctacatccatttgagagccttctaattttcttgtatcacaggactgtcgtccgacaatcataaaaatgccatcagagtctgtcggcactgtaaaagaaactgcatagtctttgtcatcttcgcccatggcaatggtaggcatgaccaacacttcatgtgagttgataatgccggtttgatgagctttggctccacggacgacgatcccgtcaggccggcgttccacgacatgcagaaaaaggtcaggatcagcctgagcatgaggagcaagggagcggtcaccttttggatctgtcatggcgccgtcagtggtcagatccttttcctgtgcatattttaagaagtttttaaagttttcgtggtagctggtgccgtatttttcatccacctcatatgtagtactgtaaactgcattaaacgcatccatacctacacagcgctggaaacaggcagcggttttttggccgcacagcctctgcatcttcacttttttaatcaaatccccggcactttgatggatatgggtaaagcggttgatcttttctcctgtttcagaagatactgcagtcatcagatcctcatattccggcatctgtgccaggtcataagtcgcttttacagaattcagggacggccttaaaatcggattatccaccggatgttcaattttttccccaaacatataaacctgaagattcagtttactcatgctttccacgtattcgtttcctgtcattaaagccatacgatcttaccttcctttcataaacggcggaagctttctgctcccgaaaataagtttgacataagagtattaagcaaaacgtgtgccaagtttttgggaaaactgaaaagctatcgctgggtatatatctgacggagattatgtctgtttttctgtaagctaacatatttttatgttcaagaaatggaacgaaaaacagtgattattttatttttggaacaatcgttgggagattgtgcataaaagcaggagatgccggttggcatggtatttgctatatataaatatcaggaggtgattgtgatgttaagggaaatagagaaggtgctggaagaagatgtgcgtccatatttgctcgaacatgaaggaaatgtccggatatcagaatataaagaaggtattttgaaagtccgcctgacaggacagtgctgcggatgtccatccgcagcactgacaaccgaagaattgattgcagaagcggtgaaaaagaaaatacctgaggtaaaggatgtagtgctggtgaatgaggtaagtgatgaccttatcgaaatggcaaaaaaactgatgagccattcgggaaagcagggggtgccatgcggatagggataaaacactgtctgttccatatatgaaacaaatgagccgcgtaaacttggacgaaactgcccggtgtgttaaaataaaaccaacgaatgattcttttgagagaaggagagagaatggacgggaagcaggaaaaacctcagattttttcaaatgtacaggaagccagtgagcggctggatgctatcattgagaattccttcgatggcatttatatcacggacggcagggcaaacacaatcaaagtcaaccgggcatatgagacgatcaccggacttgacagagcagatatgctcgggaaaaacatggaggaactggagcgcgggaatgtaatttccgtgtccggttctcttatggctatcagggaaaaaagagtggtgaccctggagcaggagtttaagacaggaaaaaaggcggtcataacaagcagcccgatctgcgacaaggaagggcagatcatcatggtcgtcacaaatgtaagggacctgactgagatttatcatctgagagaagaaatgggaaggaaaaaacaggaggaagaaaaactccggcagaagctcctgcacgtccagggggaacttttcggcagccgtatggtggcccaggataaaaataccctggatgccttgttctgggcagacaaagtatccgggctggatgcaacggtcatgctgcttggggagaccggagtcggaaaggaagagttcgcgagatatatttatcagaacagcaggcggaaagacggaagttttatcaaagttaactgcggtgcaattcctcccaatctgttggaaagtgaattgttcggatatgaaaagggagcattcacgggcgccagtaaaaacggaaagctcggtctgtttgaactggcagataaaggaaccatttttctcgatgagatcggggaactgccgtttgatatgcaggtcaagttcctgcgggttctgcaggagcaggaggtggaacgcatcggagggagcaggccggtaaagatcgatgtgagaattgttgcggccacaaaccggaatctggaagaaatggtgaaacaaaaagcattcagggaagacctgttttaccgtctgatggtatttccgatccacatcccgcctttgagagagagaagaaaagacatagagccgcttgccaggctctttttgggacagctcaataagaaatacggatttcggaaggaatttacgtttgaggctttggaactgctgaaggaataccgatggccggggaatatcagggaattgaaaaatctggttgagagggctgtgatcatcagcaatgaggacctgatcggaccggagagtatccctgtagagacaggggaaagaacacttaaagcaaaaaaacggaaaaaagaaaagagtacatccatcgacctgaaatctgaacttcacagaattgaacttcagtatatggaacaggcttataaaacatttggaaatgtgagggatgcagcattaagcctggggatgacagcgccgacctttgtgaggaaacggaaacaatatgccgaagaaaacaaataccaggttcccaatagaaaagctgattgaatggggtctaatcgatatacgggtagaagagaatcaacggtcggttgtccgctgggggaagatctttttattatcctaagaaatttgtaatattttctgcatagttttatcatacttttctggtatactaaatcatatcaggcaacaggaagggagaaactatgagaaaattggtattcaataaaaagtttttggccgcagtggggattgttctggcagtgggcggatgcttttttgtaaagggaaggatgaatacaaaagctgcggatgacagcatttttgttcagaatatgagcgttcagtacaaacagtgcgagggaacttccaaagaaattctggaagaagatatcgacgaacatatctcagaggagattatggcgctggaggaaaagggacatacctacgagatcggcgaggccttgtctgccaaagacagtgagtttatcccggtgatcaagcagatcaacgatgagactgcatatgaggccatcggcggaatcacagtgaaaaataagaactatgtcgtaaaggtcaaatcggctcagaagattactgaggaagatgtggagaacgcactggaggcggtaaaggaccagttaaactaaatacaacatcaaagatttatacgaagcacagaggaattcctttttagccgggcggcaggaagtttttctctgtgctttgttttattgcccgtattcaggctcatatgttatgataaaataaaatcagcaggaggagatttatatgattttaattaaaaacggaagagtcatggacccggaaaccggatttgataaagtgactgatcttgttctttccggtggaaagattaaaagtataggagatacagaaacagcagattttgagcagatcatagatgcagaaggtatggttgtggctcctggtctgatcgatgtccatgtgcatttcagagaccctggatttacacacaaagaagatatgcagaccgggagccgggcggcccttcacggaggtgtcaccacggtggtttgtatggcaaatacaaagcctgtggtggacagcacggagattctggatgatattctgaaacgggcacagaaactgccggtccggcttgtccagactgcggcggtatccaaaggatttaaagggaaagaactcgttaacatggaggtgctgaaagcccatggggcattgggatttacagatgacggtcttccgctcatggacgaagagatcgtccgcagggctatggagactgcggcaaaacttgatgttccggtcagtcttcacgaggaagatccgaaatatattaagcgcccgggagtcaatgccggaaaggttgccgaacagcttgagtacggcggggcttctgacgaagcggaggcggtgatggtagagagagactgccggctggcgctggaaaccggggcatctgtggatatccagcatatcagttctgccaaagccgttgatcttgtaaaggatgccaaagcgaaaggtgctcatgtgacagcggaagctgcaccccatcattttacgctgacagaagaggatgttctcacttacggctccctggccaagatgaatccgccgctcaggacaaaaaaagacagagagaggattatcgagggactgaaggaaggcaccatagagatcatcgccacagaccatgcgcctcactctgaagaagaaaaggcagcaggccttgaaaaggcaccgagcggtattaccggactggaaacttctctgggacttggtattacaaaactggtaagggaaggacatttaactttgatggaactcctggaaaaaatgacggtcaatcccgcaaaactttatcacctggaacagggaagaatacaggagggaaaaccggcagatttggttctgtttaaagaggacgaggagtatattgtagagaagttttattccaaggcctcaaactcaccgttcaaaggctggaaacttttcggcaagatttattacacaatctgtaaagggaatgtttacgatctgtcacaagattaaaaacttcatgttaatgtcatagttctgagatatctgcatgatataatgatactataaacaaatttctgactgatcatataaagccgctttgacagggcagatacgaaggaggggtgtcttatgaaaagatacggtatctgttttacaagtatcattgtagctgttgttctgtgtgcagaactcatcggatttccggtatctgtttctgccaatgagcctgagagtgcgggaaatatctcagcggacgtaaaaataaaaagaagtgctaaagcgtccggaatgaatgaagaaaatatggaagcgggccggttcgccagtatggatgaggcttccatgtatatgatgtacggagacggcatgtatacttttacccagtcctatttaagagaccacagtgacagactggtcgaactcagggtgaaggaagcgggaagtctgatccttgtatcttttcaggaagaagacaacgcacagatgccgtctctcctggatggtcagaagcagcctgtgggacagcggataccggatggggccgtgaaacttaaagcagaaccgggaacctattatgtgaggctgccgaaagactttaccacggtttttatcgcaccgtttgtcatcaaagataacccgcgtaagctatccaatgaggtttcctacattcagagcggacagggaaaatacacgtatcactcctttaccatggcaaaacgggggacagcggatatcacagcatctccgatcgtgaaacagaaaactccggttgtattttacgtccagagaagagaagacggacgctggaagaatataggacggcagcagaagtcttattttaccagtgatacaggaacagttgtctatggactgaagaggggaacctaccggattgcagcaaaggcagacataaaacagggatattcactctgtgtgatcaagacatttatcccggcaaagtataagacgaagaaaacaaaagcaaagacgttaaaaagatttcgggaacagtatgatttgtatacagtaacagaaagagcgtccagatggtaccgaatttcagttccgaagaaacggaaaaagatatcaatggaagcagaaacttatatgaactctggaaagatcaggtttactgtctataaaaagggcagaaaaaagcctgtaaaatctctgactttgtcaggagaaaaggtcaagcggttcagttttaagggcagcaaaggcacttattatataaaggtcgcaaaatcaggaagacagacaaatgggtcttattggctgtatcagtattgatctgagaataagaaggaaaaaaaagaatctatgagctgatccataggttcttttttgttttttttcataaaagtaaaataccgatatgttttctgtgaagttttactcagatttaacataacctgtcttttgaattttacattggacaagtaagatatgacttgtagcgatgaaaagccaaaaggagattattatgagaaagatgaggaaaagaattttaagtgttcttctgacagcagtggcagcgacaactttactggcaggctgcggaggcaaagacgaaggtaaaaaagcagcaggtgaagatatcaccgttgtatccagagaagacggatccggcacaagaggagcgtttattgagttatttgggatcgaagaaaaagacagtgacggaaataagatagataacacgacaacggaggcaatgatcaccaactctacttccgttatgatgacgacaatcgccgagaatgaggcagcaatcggatacatatctttagggtccttaaatgatacagtaaaagccctgaagattgacggagcagagccgagtaccgaaaatgtaaaaaacaagacttataagatcgtgcgtccgttcaacattgtgacaaatgagaagaagctgagtaaccaggctaaagattttatgaaattcataatgagcaaagaaggccaggaagtggtcgcagacaatggatatattacggtcgatgacaaggcttccgcatacaaagcagccggggcaaaaggcaagattgttgtggcaggatcatcatctgttacccctgtcatggaaaagttaaaagaggcctatacggcactgaacaaagatgtaaagatcgaagttcagcagagtgattctacaacaggagtgacttccacagtggacggagtctgcgacatcgggatggcatccagagaacttgcagacagcgaggtgaaaaaaggcgtgaagcctacagtcatcgcacaggatggaatcgcagtgatcgtaaacaagaaaaacgaggtatctgaacttaaaagtgaccagataaaaggtatttttacaggtgaagtgatttcctggggcgacgtgaaataaagctatatagtgcaaatagagagatagtggggaaataaagatgaaacagtacaaagaaaagatcatgaaaggcgtattcctgaccgcagcctgtacttccatactggcagtcatactgatatgtgcattcctgttcatgaacggcttacccgctattggggagatcggaccggtaaaatttctggccggagagcgatggatgccaaagaatggattctttggcatcttcccaatgatcatgggaagcctttatatcacagcaggagccatcatcgtgggtgtccctgtcggaatctttacggcggtcttcatggcaaagttctgcagcgggaagctttataaaatactgaagccggcagtggatcttttggcaggaattccatctgtggtttatggcttcttcggcatggtcgttttggtgccgatggtcagaaatatttttggcggcaacggaaacagtattcttacggcgtcactgcttttagggatcatgattctgccgacgattatcggtgtttctgagagtgccatccgtgcagtgccggacagctattacgaaggttcactggccctgggggcgagccacgagagaagtgtgttttttacagtactgcctgcggcgaaatccggtattttggcaggtgtggtgttagggatcggaagagccataggagagactatggcggttgtcatggtcgcgggaaaccaggccaggatgccgatggaacttgctaagggagtcaggacactgacggcgaatatcgtattggaaatgggatatgccacggatctgcacagagaagcgctgatcgccacggctgtggtgctgtttgtctttatcctgctgattaacctttctttttctgcattaaaacataaggaggaattctgatggaggcgatgacagcaaagccattaaacggtataaaacaggtgaataaggtcacaaggaaacagagattttcttcttacaaaagaactccgctctctctgcttctgtatctgctggtgctgatatccacggtctttacggcgggaattttgatctatctgatcggatatattttggtgcatggggttccgtatcttacaaaagatctgttttctttaaaatacacatcgacgaatgtatcactttttccggccatggtcaacacggtcagcatgacagcactggcgctcttatttgcagtgccgctgggaatcttttctgcgatttatcttgtggaatatgccaagaagggaaaccggcttgtggggatcgtcaggattactgccgaaactctttcaggaattccgtcgattgtatatggactgtttggtatgctgttctttgtgaccacattaaaatggggactgtccattttatcgggagccgcaacactggcgattatgattctgccggctgtgatgagaaccagcgaggaggcattaaaatctgtcccggattctttcagggaaggaagcttcgggcttggagcgggaaaacttaggacggtctttcagatcgtgcttccgtctgcggtgcccggcattttgtccggagtcatattggcagtgggaagaatcgtaggagagacggcggcgctgatgtatacagccggaacagtggcagagataccatccaatgtgatgggttccgggagaacattatcagtccatatgtatgcactctccagcgagggtttgcacatcaatcagtcttacgccacagcggtggttctgctgatcgtagtgatcgtcattaacgcggtgtcgacatttattgccaagcggataacgaaaggatagaacatggaatctaaaatcaaagtacagaatctggatttatattacggggattttaaagcgctcaaagcgatcaatcttgatatttccccgaatgagatcacggcatttatcggtccgtccggctgtggaaaatctacacttttaaagtcattaaaccgtatgaatgatttggtggaaggatgtaagattacgggaaaagtcactctggacggagaagatatttacggagatatggacattaatctgctcaggaaacgggtgggtatggtatttcagaaaccgaatccgtttcctatgagtgtctatgataatgtagcctacggaccgaggacacatggagtcaggaacaaagcgcagctggatgagatcgtggagaaatctctgagaaacgcggcaatctgggatgaactgaaggaccgactgaaaaaaagtgccatgggcctttcgggaggccagcagcagagactctgtatcgccagggctctggcagtggagccggaggtgctcctgatggatgagccgacgtctgccctggacccgatttctacctcaaagatcgaggaccttgcggcagaactgaaatccaagtatactatcattatggtaacccataatatgcagcaggccgtccgtatttccgataagaccgcatttttcctcttaggggaagtcgtagagtatggaaagtccgatcaactgttttccatgccgaaagatcaaagaacagaagactatattacaggaaggtttggttgatatgagaaatcggtttgacagacagcttgaacagctgaatattgaaatgatcgagatgggtgccctctgtgaggatatgattcatctggcagggaaactggtagatacaaagagcaaagagatgatttcaaggatcaatgatctagaagaagagatcaatcagaaagagcgggacatagagagacgatgtatgaagcttctgctccagcagcagccggtggccggggatttgagggtgatttcagcagcgcttaaaatggtttctgatatggaacggatcggggatcaggctgtggatatcgcgggcattgtaaaaaagagtgatgtggtgactgtgatgaatcatcacacccatgttctgatgatggctgcaagaacgctcgccatggtcacaaaagctgtggattcttttgtaaaaaaagatctggatgcggccaatgaggtgatcaaagcagacgacgaggtggacgctctgttctcaaaggtgaaaaaagaagtgatctctttgattcatgaggacccggaaaaaggagaggcctgtgtagcgattgtcatgattgccaagtattttgagcggatcggcgatcacgccagcaatatcgccgaatgggtagaattctctatgaccggggaatataaaggaggaagtctgtgatttatattgtcgaggacgatgcgaacatacgggaacttgtcatttatactcttcagagtacaggatttgatgcggggggatatgaaagcggcatcagcttttttaaagatctttcggctggaaagattcctgaactggtgcttctggacattatgcttcctggggaagacggcattagtattttaaggaagatcaggagcaatcctgagacaaagcatatcccggtgatcatgatgacggcgaagggcgccgagtatgacaaggtgctgggcttagacagcggagcggacgattatattacaaaacctttcggcatgatggaactggtatcccggatcaaagcggttttaaggcgggtaaaaaaagaggagccgacggaagaactttcggcaggaaatctctatatccatgtgggaaagcataaggtgctggcagacggtgaaaaggtggagctgacctacaaagagttccgcctgctctgtatgctgatggagagcaaaggcaatgtgctcaccagagaccagcttctcacaaatatttggggttatgattttgatggcgagacccggacggtggatgtccatatccgtaccctgcgccagaagctgggagaatgcggatctatgatcgagactgtgagagggatcggttaccgcattggaggaaatgaatgaagcgtaagatatttctgaatatgagctacattgccctgatcacggtggtgtgcactacggtatttttatctgcggtcgcttacggaagatatatgtcccaggtaaaagagggaattcagaacgaggccggatatatggcggagtccctgaaccagcatgagaaccagagtctggatgcatacaaagatatcacgatcagcaggatcacgctgatcgctgcggacgggaaagtcctgtatgacagtacgggaaaagaaaagtccatgagcaatcacagaaatagaaaagagttcaaagaagcggcaaaaaatggggccggcgagagtacaaggatttctaagaccctcaaaaaacaaacgtattactatgctgtaaagctttcggacggcagtgtcttacggctcagccgggagactcagactatttttaatcaggtggagggcgtactgcctgttctgattttaatgatggcagtggtttttgttttggcgctggccctttcaagactcctcaccggaaggattattgagccgatcaaccggatcaacctggagcatccggaagatgaaaatacctatgacgagctgtcacctctgctggtgaggattcaccggcagaatgaagcgatcaaagaaaagatcagagagatcaaggaaaagcagatcgagtttacgacgattacagaaaatatgagcgaaggctttctgatcctcaatgataaatctgtggtgctttcttacaatacgagtgctcttcggattcttgacatcagggaagatcagtgcagcaaccagaatgtattgtccattaaccgcagccatgaattccgcagggcggtggaggcagctttgaatggtgaggcttttgaggaagtgatggaatttcgcgagcgcaagtacctgctgatggccaatccggtgacggtatcaggcgcagtgaaaggagcggtgctgatgatgattgatgtgacagaaaaagaagaaagagaagaactgagaaaagaattttctgccaatgtatctcatgagctgaagactccgctgacgacgatttcgggatatgcggagcttatgaaagacggactcgtaaagcaggaggatgtaggccggttctcggaaaagatttacacagaggccagaaggctcatttccatgatagagggtatcatcaaactgtccagactggatgaaaatcagattatacaggaaaaagaagaggttgatctgtatcagctggctttggagatcaaaaactctctttctatgaaagcggcagaggaaggaattgacattcaggttctcggctcaccgtgtaaagtctcaggggtacgccagatcttatacgaaatgctgtataatctcatggaaaatgcagttaagtacaatgacaggggaggtcatgtgtttgtaaccgccgctgtcatggaagggcgggctgccgtgattgtagaagatgacggtatcggcattccgccggaagatgcggaccgtatttttgagcggttttaccggggagacaaaagccattccagtgagcgggaaggcacaggcctggggctttctatcgtaaaacacggagctaaataccacggcgcaaagatcgaagtggaaagtgaagtgggcaggggaacaaaaattgcagttattttttagcctaaaagaggcggtcctttttggatcgtctctttttttctccttctttttatgttatgatttcagttaagtatgacattttccacatgatttccgttcggctcttagaatgcctcactccaatcatgtagaaaatggacataatgtctgctggaaaggtattcttcgaataaaatggactattcaaagtaaaatttctttattcgtcggctttttccagaagaaactatgtccatctcgtccattttcattaatataaaggagaattgacatgatcaatgaattagtaaaaaaaataaaacagctggatgcaccgatcgtggtgggactggacccgatgcttgattatgtgcctgaccagataaagaagaaagcatttgacgaattcggtgaaactttgaagggtgccggggaagcagtctggcagtataataaaggaattattgacactacatacgatctgattccggcggttaagcctcagatcgccatgtacgagcagttcggagtggaaggcctgatcgcctttcaaaagacttgtgaatatgcaaaggaaaagggacttgtggtgatcggcgatattaagaggggcgatatcggctccacatcagcggcctatgcggtgggacatgccggagcagtacaggtgggcagcaaaaaataccgcggattcgatgaggattttctgacggtaaatccataccttggcagtgacggtattctgccttttattgatgtatgcaaagaggagaagaagggtctgttcattctggtcaagacgtccaatccttccagcggagaatttcaggatcagcttgtagatggaaaaccgttatacgaactggtggcagagaaagtggctgtgtggggcgaaagccatatgggagacgattacagctatatcggagccgtcgtaggggcaacttatccgaaaataggagaagtcttaagaaaaatcatgccgaaaaattacattctggttccgggatacggtgcgcagggagggaaagcagaggacttaaaaccgttctttaatgaggacgggctgggagccatcatcaattcttccagaggcatcatctgtgcgtacaaacaggaacagtacagcagctttggggctgagaattatgcagatgcatccagacaggcggtgctggacatgaaagaagatctgaaaaaagcatttgtaaaataaggagagaccgatgggaaaacagaacataaaggctgagattctcagccagaagaagctttccgcagatatttttgacatgacgctgaatgttggagatatggccagggaggctgtgccagggcagttcgtatctgtctacgtcaacgacggaagcaaacttttgccgagaccggtcagtatctgtggtattgacagagaacagggcacaatcaggcttgtataccggattgcgggcaggggaacggaacttttaagtacctatgaagcaggaacccggataaacgtgctgggtcccctgggcaatggatttacaatgaaaaaagaaaaagcgatcttgatcggcggaggcattggaattcctccgatgctggaacttgcaaaacagctgggctgtgagaaaaacatcgtgcttggctatcgggatcaggatacttttttaaaggaagaatttgagccatacggcgatgtctatgtctcaacagaagacggttctgtggggacaaaaggaaatgtgattgatgccgtcagagaacaggcggtacagggtgctgtcatttatgcctgcggaccgacacctatgttaaaaggtgtcaaagcttatgcggcggaaatggggctggaagcccagatttctctggaagagcgaatggcatgcggcatcggtgcgtgtcttgcgtgtgtctgcaaatcaaaagaagtggatgggcatacccatgtccataataagcgggtctgcaaggatgggcctgtatttgacgcaaaggaggtagaactctgatgaatttgggagtagagatcgcaggagtttctttaaagaatccggtgaccacaggctccgggactttcggttccggggaggaatacagtgaatttgtcgatctgtccagccttggagcggtgacgacaaaaggtgttgccaatgtgccctggccgggcaatccgacgccgagagttgctgagacctacggaggtatgctcaatgcggtaggacttcagaatccgggtgttgacgtgatgattaagagagatctgccgtttttaaaggaggcaggagccactgtgatcgtcaatgtctgcggaaaaactaccgaggattatcttgaggtagtggaacggctgtctgaccagcccgcagatcttctggagatcaatgtttcctgcccgaatgtgaaagagggaggcattgctttcggtcaggatccaaaagcattgtacgagattacaaaagcagtaaaggcaaaggcaaagcagccgattatcatgaaactgagtcccaatgtgacagatattaaagaaatggcaaaggccgcagaggctgcgggaagtgatgcgctgtctctgattaatactctgaccggaatgaaaattgatattgagaagagggattttcttctggcaaataaaacagggggactctcagggccggccatcaagccggtggcagtgcgaatggtatatgaggtgtgcagtacggtgaagattccggtgatcggaatgggaggaatccttactgcagaggatgccctggagtttatcatggccggagccgctgcggtagctgtaggaacagcgaattttacggatccgtgcgcgactgtcaaagtgattgaggggataaagtcttacatggaacgccataacatagaagatatccgggaattgatcggatgtgtaaagtaaactgcaaaagatgacggaagtgaggtcagcatgaatatattatttttcttgacgccgaaggaagatgtatcatatctgccggaagattatactttgagacaggcgctggagaaaatgaaataccatgggtactcggcagttcctatattgaccggcgacggaaagtatgtgggaaccgtgacggagggggaccttctatgggcaatgacggatgatgccggatttgaccttgagaaggcagaactgatctttttaaaagatatgaagcgcagaagggacaacaggcccgtgacaatcaatacagatatggatgacctggtggatgtgatcaaagaccagaattttgttccggtcatcgacgatgaacagaggtttatcgggatcgtcacaagaaaagatgtgatcgggttttattacagagaatatcagaaggctgaatataaggaggaacatgatggaacagtataaaaaagagtttattgaatttatgatcgactgcaacgttttgaaattcggagattttgtgaccaaaagcggaagaaacacgccgttctttgtaaatacgggattttaccggaccggtgcccagttaaagaagcttggaacttattatgcaaaggccattgaggcgaaattcggatttgactttgatgtcttgttcggacccgcatacaagggaatcccgctgagtgtagccgccgccattgcaatctctgaaacctatgggaaggatatcaaatactgtgcaaaccgcaaggaagtaaaagatcacggggacacaggaatcctgcttggaagtccgatcgaagacggagataaggtcgtgatcattgaagacgtgaccacagccggaacctccatccaggaaacacttccgatcgtgaaagcccagggtgatgtggatgtattggggctcgtggtttctgtggaccggatggaacggggacagggaacaaagagcgccctggaagagatccgtgaaaattacgggctggaaactacggccatcgtaacgatgcaggaagtggtggaacacttgtataataaaccttataatggaaaagttattatcgacgatacattaaaggcagctattgacgcatactatgagaagtatggcgttcaataaagaagggtttatttgtgacaagaaaaaagaaaagggcagccaggtttggctgccggattttattttatttgtatctcattgtgatgttttattttgtgctgttcagtgagcgttacggcagagagactgggtatgatacatcccatgtaaatctggaattgtttaaagagatcaaacggttctggatgtatcgatccctgcttaccccggaggcatttataacaaatttggtcggaaatgtttttgcattcagtccgtttggatttctgctgcctgtcatgacagagaaaaaacggggactgataaaagttgtcctcggatcatttttattcagtctgatcattgaaagctgccagtatatttttaaggttggggtctttgacgtggacgacttactgttaaacacgatcggcggactgatcggttatatcatctacaaaatttccgtcacgatttaccggaggaaataatatgcgggttaataaaaagaaacgtcaggcctatcgtccgtcggatcacgttgtatccagggagtcagcagtttccagtattctcggagccataggaattttcggctatcttattttagtcggagcttcctttcaggcggccggaaacgggggaatactgctcggcgcagctgcgtgggtgctgtttggcatctctgtctttggaatgatgctggcagtgcgcagctatcatgatacggcatccatcagggtctggaaagtggtcggaagtattacaaacggagcggtgcttttgttttcagctgctttgtttgtgatcggattgatttaggagggagttatggaacgacttaagaaacagatggagtttatcatagaggtggataagctcaaagacattattcgtcagacgaatctgacaaatggggaaagaaaagaaaatgatgcggagcattcatggcatctggcactgatggctgtttttctatctgaatatgcaaaggaaccggtggatgtccttcaggtgatcaagatggttctgatccatgatctggtggaaatcgatgcaggagacacttatttgtacgacgaagccggaaatggtacgaaagcggcaagagaacagaaagcggcggaacggatcttcaacattcttcccggagatcaggcagaagagctgtttcaactgtggcaggaatttgaggaccgtaaaacaccggaatccaagtttgcgaatacactggaccggattcagccggttcttttgaatgatgccacagagggaagggcctggagagaacatgacgtctgcattgaccagattatgagcaaaaatgagtataccagtcagggatctgatgtactctgggcgtatattcaggaagtttttgagaaaaatatagaaaacggaaatattaaaaggagcttataacgtggatgaattattaatggaacgccattttctgaaccaggaaaggctcaaggctattttacaggaagactctgtaaaagagccttttttggattatttcagaaaaatggcggagaggcttttatttgccgacgaagtatatggaacaaaagacaaacagctgtttcagctgaaagagtggaacaaagagtggtatgagcaaattctgccgtctgagtatgatgtatgctatggaaatccggactacgcccggaatgtttttggggaagagttcggggatattttgtgctttttgtatgcagaaatccagggctgctttgtttatgcggtggaaggacagctgtttgagctgacaattatgaatgaactgtttttagaaatctatcagctgtttctggaaggggatgtacagagaaagacggcaaaacaggtcatctttgaccatatgagagattacagccaggaactctgctataaccgtgtcagggagcagctggatccgtgtgtgtcttctgcgtcagatattgtgatgaaggaggatctggacaatacggatgttctatatctgtatggtgagtatgtctcagaaaatgagacaaagatgctttcttttttaaacagtcttcctaaggaacggatgaaagagattgccaaaacttttgtggacggatatcacgatggctttattatcaacaacattgatatgtcaaaaaaaacaaccgtaaatatccggtatcatctcgggttcgaaccaatcatcagggaggctgcactgcagtttcaagagatcgggctgactccgattctgtaccggggcactacgggtgtgattacaagagggatgtcaaaagtcgggtacatttccacaagtccaaacccccagtttgagtatgaccacagatttgaccaagcgctgttttttaacaaagcgtttatgagccacaagctggaaagctatcggaatgcctatgaaaaattgaaggaggaggctgcagcatttgcaggacctgcatgcatggagacgttcggggaactgccgtttacgccggagaataaagagactgctctgcgtctttccgagaagcagcaaaagctttctgtggagtaccagaatgagtccggcaggattgccaacgagtatatgaaaccggaggagcggagttttacgatcatcgcatatccgatcccggaaataggggaaaacttcgaagcaatcttcgaggaggtggctaaggtcaatacgctggacaaagaaaaatataagaaaatccagcagcatctgatcgatgccctggaccagggtgtggaagtccatataaagggagcgggagagaacgaaacagacctctatgtggccatgcacgagctggaagatgctgagaaggagactaactttgaaaattgtctggcagatgtaaacattccggttggtgaggtgtttacttcaccgaaattaaacggaaccagcggagtgcttcatgtgagtgaggtctatttaagagatctgaagtttatcgatctgagactggttttcaaagacggtatgattacagagtattcctgccggaatttcgagtcggaagaagataataaggcatatataaagcagaaccttctctataacagggagactcttcccatgggagagtttgccatcggaaccaatactacggcctatgccatggcacagaagtttgggattttatatcagcttccaatcctgatcgtcgaaaaaatgggacctcattttgcagtgggagacacctgttacagccacagcgaagcaaccgagcttcacaatcctgacggaaaagagattgtggcaaagagcaactgtttttcagaaaaaggagaatattttaactgtcatacggatatcaccattccttatgaggagctggattccatctgcgtgatcggcctcggcggcaggaaaacggctttgataaaggaaggaaaatttgtcctcccgggcacagaaatcctgaacgaaccattgacgtaaccggatacagtgggtagaataaaagaaaacaaatcgaattatgacaaaggagacagaattatggcaaaagtagcgattgttatggggagcgattccgatatgcctgtgatgagcaaggcggcagattttttagaggagatggggattgactttgagatgaccattatttctgctcacagagaaccggatattttctttgagtgggcaaaaggagccgaggagcgcggagtcaaggttatcatcgcaggtgcagggaaagcagcacatcttccgggaatgtgtgcagcactgttcccgatgccggtcatcggaattccgatgaaaacttctgatcttgggggagtggattctctttactccattgttcagatgccgtccggagttccggttgcatccgttgctatcaacggagggcagaatgcaggaatccttgcagcacagattttggcttcgtctgatgccggtcttcttcagaaactgaaagattacaggacaacaatgaaagaatctgtagtaaagaaggccgataagcttgaccaggttggctataagaactatgaataagaaaagacttgcagccgtacttttatgtacggctgtttgtgccggacttgcagggactgcattacaaaatcgggatactctggcggggacatgccagatcacggtggcgattgatgccggacatcagaaaaagggtgacaccaggaaagagccaatcggaccgggttcccggaggaagaaagcaaaagcggcatcgggtacacagggagcagcgacgaaagtaccggaatcaaagctgaccctcagtgtggccaagagactcgagcaggagcttaaaaaaaggggctataaagtctacatggtaagaagaaagcagaatgtcaacatcagtaataagaaaagagcgctgctggtgaataaaagcggcgccgatatctgtatccgtcttcatgcagatgcggcgggaaaaagagtacgcggtgcctcagcattatacccgaccaagaagaatccctatgtaaaaaagctgagcaaacgcagcaggaagctgtccggggatgtgctgaaaaaatactgcaaagctaccgggatcagaaaccgtggactttcagggcggaatgatctgacgggcactaactggagcaaagtcccggtgacactaatcgaaatgggatttatgacgaataaaaaagaagacaaaaagatgcagaagagttcttttcagaaaaagatggcgaaaggaattgcagacggcgttgacagttattttggaaaatagacaggacctgtcccggggatcgggtctgagtttaaaaagatatacattttaggaggataaaaatggattacaaaaaggcaggagtggatatcgaagcaggttaccagtccgtagaactcatgaaaaagcacgtacaggccacaatgagagaggaagttttgacaaacatcggaggattttccggggctttttctttaaagaagtttaaggatatggaaaatccaactcttgtatccggtactgacggagttgggacaaagctgaagcttgctttcgttatggataagcatgatacgatcggaatcgactgtgtggcgatgtgcgtcaatgatatcgcgtgtgcaggcggggagccattatactttcttgactatatcgcatgcggaaaaaactttccggagaagattgctaccatcgtaagcggagtggcagaaggatgtaagcagtctgatgcggctctgatcggcggggagaccgctgagatgccgggattttatccggaggatgagtatgatctggcaggttttgccgtgggtatcgtagacgaaaaggatctgattaccggaaaagagatcaaagagggagacgtgctgatcggcatcgcatcttccggaatccacagcaacggatattctctggtgcgcaaagtgttcgatatgtcaaaagaatcactggagacttaccatgaagaattaggaacaactctcggggaagcgctcctggcacctacgaagatctatgtcaaagcactgaaggcgatcaaagaagcgggtgtggaaatcaaaggctgcagccacattaccggaggcggtttttatgagaacattccaagaatgcttccggacggggcccatgcggtggtccacaaggacgcatatgaagtgcctgcgatctttaagctgcttgcagaaaccggggatattgacgaaaagatgatgtataatacatacaacatgggaatcggcatgatggtggctgtggacgaaaagagcgtcaacgatacgctggaagccctggaacgtgccggggaaacggcatttgtagtaggtgagatcaaagccggtgaaaaaggtgtgacggtatgttaagagtcgcagtattagtgtctggaggcggaaccaacctgcaggctgtaattgacgccattgaggaagggcggatttccaatgcccggatcgacgtggtgatcagcaataataaaaaggcctatgcactggagcgcgccaggaagcatggaatccaggcagtgggactgtcaccgaaagattttgagaacagagatttgtttaacgaagcactttatcaggagctggctggcagagagattgatcttgtagtgctggccggatgtctcgtagtgatacctgataaaatcatccgtgagtttgaaaacaggatcatcaacattcatccgtctctgattccgtctttctgcgggaaagggtgctatggactgaaagttcatgaacaggcgcttcaaagaggtgtcaaaatttcaggcgctaccgttcattttgtagatgaaggtacggatacgggtccgatcattatgcagaaggctgtagaggtaagagacgatgacacaccggaagttctgcagagacggatcatggaacaggcggagtgggtgatccttcctgaggtgatcaatctgatcgcagaaggaagcgtttcagtttcagaaggacatgtaaagattaagaaataaaagaaaggataaaaggatggatatactgattgttggcagcggaggacgtgaacatgccattgcctgggcagcggcaaagagcccgaaagcagacaaaatttactgtgctcctgggaacgcgggtattgcggagtttgcagagtgcgtggacatcaaagccatggagtttgacaaactggtggcgttcgcaaaggaaaaacaaatcggtctgacgatcatcggaatggatgatccgcttgttggaggtgtcgtagacgcttttgaagccgaaggactcagagtgttcggtccccgcaaaaatgcggcgatcatcgagggttccaaggcgttttccaaagatctgatgaaaaaatacaatattccaacagcatcctatgagaatttcaccgatccagagcaggcactcgcttacctcgagaccgttaagatgccgatcgtactcaaggctgacggactggcactgggcaagggagttttgatctgtgagactctggaggaagcaaaggcgggcgttaagactttaatgctggacaaacagtttggggatgccggcaatgagatcgttatcgaagagtttatgaccggcagagaagtttctgtattggctttctgcgacggaaagaccatccggtgcatgacttccgcacaggatcacaagcgtgccaaagacggagacaaaggactcaacactggaggtatgggaaccttttctccgagtccattctacacgaaagaagtggaagaattctgtgaaaaatatgtataccagccgacgatggatgccatggcttccgaagggcgtccgttcacaggcattttgttcacagggctgatgcttacagaagacggaccgaaggtactggaatataacgccagattcggagatccggaggcgcaggtagtcctgccccggatgaaaaatgatatgatcgaagtgatggaagcctgtattgacgggaaactttccgatgttactctggaatttgaggaaaatgcggcagtctgtgtggtgctcgcatctgacggatatccggaaaagtatgagaagggttttgagatcaagggactcgataagtttaaagaccaggatgactactatgtgttccatgcagggacaaagtttgacggagacaagatcgtgaccaacggcggacgggtactcggcgtcgtggcaaagggcggtgacctgaaagctgcccgtaaaaatgcatacgaggccgcagaatggatcgattttgcaaacaaatataaaagaaatgacataggaaaagctatcgacgaggcgtaaaaacttgtattcgggaagcaggatggagaagaaattctctgccctgcttctctatttttttacattgacattccgtgctatttattatagtctaagtataacaaaagatatgaaagaaggaagggatgaatatgctgcttgaagtagattttaacagcgatcaggccatttatattcaactgagaaaccagatcatcgttggtattgcgtgttccgacatccaggatggcgagtccctgccgtcggtgcgccagctggcacaaatcttaggagtaaacatgcatacggtaaataaagcatatgctatattaagagaagaaggctatttgaagctggaccggaggaaaggcgcagtcgtaagcgtggatgccaatgaaaaggcaaagcagctggaggaattggaagagagccttcagattttggtggcgcaggccatctgcaagggtgtgacgagagaagaattatatcagctgatcggccacgtatatggacagcttgacagaaattaggaggacagaatgagaaaattaccacttaccagatatttaagccatgcattggaggaggcgggaaagatatccgcgaggcttggagcagaacatatagaaactttgtctcttttgcttggactgcttaaaatgaaggggtctctggcctgtgagatactgaagatgcacggggtgtctgaggagattttttcagaagctttcaaggcgcgtactgcagaaaaaaagaggcgtacaaaggtaaaaacctttactcccaggacagaggagattttaagccttgccgcccagatggcagttaagtacggaagtgatgtgctcggcacagagcatgttctgctggcggttttgaaggacggcgaaaatgaagcggttcagctgctggcacagcaaaagattccggtggatgccatattcattgatacattggtgacaatgggaatcgattataaatctgccaagaacgaattttccaacagttcacctgatgattatttcacggaagacggagccggagaaaatattttggagaagttcagcacagatctgactcagaaggcaaaggacgacgaactggatccaatgatcggaagagaagacgagatggagcggctgatgcaggtattgtgcaggaggtccaaaaataacccttgtctgatcggagacccgggtgtgggaaagaccgctatcgttgaagggctggctgcgaggatcgtgcagggtaacgtgccccttaatctaaaggataagagactgctctctctggatctgacaagagtgatcgcagggacgaagtaccggggggagtttgaggagcggatgaaacagattatttccgaggtgacggaagatccttcagtgattctctttattgacgaaattcacacgatgatcggggcaggaggttctgagggagccatggacgcatccaacatcctgaagccctctctcgcacggggagactttcagctgatcggggctacaaccagcgaggaatataccaaatactttgagaaggatgcagcacttgtgcggaggtttcagtctattttggtggaggagccttcggtgaaagaagcagtcaagatccttgaagggctcaaatataagtttgaatctcatcacagagtgctgattcctgaagaggtgacttcctatgcggtggatctttcctgccggtatgtcaacgaccggtttctgcctgacaaagcaatcgacgttctggacgaggcctgtgccaaaaagcggatgaagtctttgaaagtgccgtcggatatgaaagaggaacaggagcagcaaaagcagattgtaaaagaaatggaagcttacatcagcagcgggcagattgaaaaagccagagaactgaagagcaaaaaagaggaactcggcaaaagtcttgagaagaagtaccgcaggatggaaaaccagcagaagaagataccttccattgagatggaagatgtggaggagatcatttctctttggaccaagatcccggtgaaccagctgaaacagggagagatggagagacttcggaatctggaaaaaattcttcacaaacaggtgataggacaggataaggccgtggaagctgtggccagagctataaagcgcagcagggtcggcctgaaagatccaaaacgccccatcggttccttcttatttctagggcctaccggtgtgggtaaaacagagctttccaagagtcttgcgaaagccatgttcggaagggaagaagacctgatccgcgtagacatgtctgaatacatggaaaagcacagcgtatcaaagatcatcggatcacctcccggatatgtcggtttcggagaaggaggacagctgagtgagcaggtcagaaggcatccatactctgtgatcctgctggatgagattgaaaaagcgcatccggatgtatttaatatcctgcttcaggtgctggatgacggacatattacggactccaacggaagaaaagtcgatttcaaaaacacagtgcttattatgacttccaacgcgggcgcgtccaggatcatttctccgaaacagcttgggtttgtcagaacttccgataaggaaaagaatcatgagaagatgactcagggtgtgatggaggaggtgcggcagattttcaagcccgaattcctgaacagaatagacggaacgattgtatttaccatgctgacgaaagatgagctccgggaaattgcaaaactctttttgaacaatttaaaggaacagctgatgaaaaaccatcggatctcggtaaagatcacgtccaatgccgtttcattgctggcagacaaagggtacagtgagacgtacggtgcaagaccgctgcgccgtgtgatccagagtgagatcgaggatgtgctggcagataagatcttaagcggtgagcttcgggacgaagcagcgcttacgatcggagcaaaagacaaaaaccttactttttcgataaaggatgctagtaaataagcagcaaatattatataataaaataacaaatgcagatttaataggaggataagaacatgtcagtggtaacagagttgtttcgcagcgaagaaaatgggacattaagcttcggagattacacattagatacgaaagccaaaaaggacaagatcgaatttgaaggggatatgtacaaagtgaaaaccttcaagacaatgacaaagctggacaaaaacggacagctgatctttgaatctgtaccgggttccgccgtccacaattttgctgcaacaacagacggagtggcatttgagatcgaggcatcagaagatgtccaggtaacgcttgaagtggagcctgaacaggaataccgcgtatatatagacaatataaatgttggaaacatgaaggccaatctaggaggaaaactcactctgagtgtggaactgaatccgggcatgacggctatggtccgtgtgaagaaacagtaaggagcaggaactgatatggcaaaggcaaaaaccgtctttttctgcagtgagtgcggacatgaatcatccaagtggctgggacagtgtccggcctgcaaatcgtggaatacctttgtagaagaaaaacaatcagtgacaaaaaagggaggggcaaagcccaggcgggcttctgcctctcctatgaatatgtcagaggtttctataaagagtgaggaacgtattccgacaggcataggtgagctggacagagttctcggaggaggaattgtgaccggctctctgtctttagtgggcggagacccggggatcggaaagtctactctgctgctccaagtctgcaggaatttagtaaatgcaaagcggaaagttttatatgtttccggggaggagtccgcacatcagattaagatgcgtgcagagaggatcggggcatttgaggatgaacttctgctgttctgtgagacgattctggaggagatcctcgagggaatccgcaaagtccgcccggagtttgtcgtgatagactccatccagacgatgtttagtgaagaactgaccgcggcagcgggaagtgtatcccaggtccgggaagtgacggctcagatgatgaggatcgcaaaagaagaaaatatcgcagtcttcattgtcggacatgtgacaaaggaaggtgtcgtggcagggcccaggacactggagcatatggtggatacggtcctatattttgaaggggagagggaggcggcataccggattctgcggggagtgaagaaccgcttcggctccacaaatgagatcggtgtgtttgagatgtgcgcagatggtcttacagaggtggagaatccgtccaagatgatgctgaacgggcgccctgtggacgcctccggttctgtggtagtatgttccctggagggaaccaggccgattcttatcgagattcaggcactgatctctcccacgagttttcagatgccgaggagaacagcggtgggaattgactataatagggtcaatcttcttatggcagttttggaaaaaagggtcggtctccagctgggcggctgtgacgcctatgtgaacctggccggaggcatgaggctgggagagccggcgattgacctggggattattctggccattgcatccagctataaaaacatacctctcccggaagatacgatcatcttcggggaagtcgggctggtaggcgaggtacggagagtatcccagggagaccagaggatcaaagaggcggaaaagcttggatttaaaacctgcatccttcccaaggcaaatgtggacagcttaaagatcaggacaaacatgcggcttttgggcgtcgcaaatgtaagagaagcccttgattgtatttaaaatatgtcttatattattagagaataatgaaaagtatggaggaatggagacacgatggaagaggcgatctcaaaaaattttatagaacagatcattgaagaagatctgaaagaagggaaatacgaaaaaattgtgaccaggttcccgccggagccaaacggctacctgcatatcggacatgccaaatcaatccttttaaactatggactggcgaaagagtacggcggagattttcatttccggtttgacgatacgaatccgacgaaggaaaagaccgagtatgtagattcgatcaaagaggatgtggagtggcttggagcagattatgaccagacgatttattttgcatccaattattttgaccgtatgtatgaatgtgcagagttcctgatcaagaaaggaaaggcctacgtgtgcgacctgacgccggaggagatccgggaatacaggggaacgctgacggaaccgggaaaaaacagtccgtacagagaccgtacaccggaagaaaaccttgcattattccgcgcaatgaaaaatggagagtttgaagacggaagcaaggtgctcagggctaagattgatatgacttccggtaatatgaacatgagggacccgatcctttaccgtattgccagaatggaacatcacaatacaggtgacgattggtgcatttatccgatgtatgattttgcgcatccgctggaggatgcctttgaaggcgtgactcattccatctgtacactggagtttgaggatcacaggccgctatatgactgggttgtaaaagagtgcgagtttgtacatccgccgaagcagattgagtttgcaaaactttatcttaccaatgtagtcacgggaaaacgctatatcaagaagctggtggatgacggaatcgtggacggctgggatgatccgaggcttgtgacgctgtctgcactgagacgccgtggatatactccggaatccatccgcaggtttatggagctggtcggtgtggctaagagtcacagctccgttgattatgccatgcttgagtactgcatcagagatgacctgaagctgaaaaagccaagggtatcggctgtcctggacccaatcaagctggttattacaaactacccggaagacaaggtagagtatatggaagtaaaaaataatcaggaaaatgaagagatgggcacaagaaaagtgccgttttgcagagaactgtatatagagcgggatgattttaagattgagaggccgaagaagtatttccgtctgtatcccggcaacgaagtgcgtctgatgaacggatattttgtgacctgcacagactacgtgaccgatgaggacggaaatgtcacagaggtactctgtacctatgatccggaatccagaggaggcaacagccccgacggacgaaaagtgaaggggaccattcactgggttgccgctccttttgcaaaaaaggccgaagtccgtttatatgaaaatattgtagatgaggaaaaaggcgtgtataacgaggatggatctgttaatttaaatccagattctctcataatattaaaagactgctatgttgagccgtctcttgaggaggcagctcctggagacagcttccagtttgtcagacaggggtatttttgcctggacacaaaagatacaacaaaggatcacatggtatttaaccgcattgtttctatgaagagctcttatcagcctaaatagaagcagaagagagataagccgttttataacggcttatcttttcattttctgagaaatgaagaatgctccgcagagtgcatttgactactttgtttaatttttggaaacaatgaaggagatgaagatgaaaaatcttacggagatgtccaatgaagaactgtgggaactttttcccatagttttgtgcggccataaggaagaatggaagcagatgtatgaaaatgaaaagaaactgctgcttcattcgattgggcgggaccaggtggcgaggatcagtcacatcggcagcacggctgtgaaagggcttttggctaagcctacgattgatatccttttggaaattgaagaacactgcgacctgaaggaactgatccgggcggtggagaaagaaggatatatctatgagaagaagccgaggaatcctcccccgcatatgatgtttatgaaaggttatactttacagggatttgcaaagaaagtctatcatctccatgtaaggtatacgggggactgggatgaactttatttccgggattatttgaaacggcatcgggaggcggcagaagaatacgggaaattaaagactggtcttcagaaaaaatatgaacatgacagggatgcctatacaagggcaaagacagattttgtaagagagtgcacgaaaaaggcccggaaagagtttggagatatctaccggccagacggtgaaaagtgaaaaaatttttcaaaaaagcccttgcaattttttgatagggtgttatactatattttgtgattagcactcgatgagagtgagtgctaacaataatcgggtaaataagacaaaagaatttcatctgaattttaggaggtaatgatatgaatttaaaaccattaggagacagagtagtgctgaaacagctggaagctgagactacaacaaaatccggaatcgtgttgacaacagcatctcaggaaaaaccgcaggaagccgaagttgtcgcagtcggacctggaacggatgaagtgaaaatggaagtagaaaaaggacagaaagtcatctattccaaatatgcgggaactgaagtgaaatgtggagatgatgaatacatcatcgtaaaacagaacgatattttggcagttgtagaataggatttttggaggagacgaatcatggcaaaagaaatcaaatacggaattgatgcaagaaaagcgttagaagcaggtgtaaaccagttagcagatacagtcagagttaccatcggaccaaaaggaagaaatgtagtgttagataaatcttttggtattcctctgatcacaaacgacggtgtgacaatcgcaaaagagattgaattagaagatgcattcgagaacatgggtgctcagattgtaaaagaagttgcaacaaagacaaatgatgttgcaggtgatggtactacaacagccactgttttagcccaggcaatggtaaatgaaggaatgaaaaaccttgcggcaggtgcaaatccgattattttaagaaaaggaatgaaaaaggcaacagatgcggcagtagaagcaatcgctgagatgagcagtaaagtaaacggcaaagatcagatcgcaaaagttgctgcaatttctgccagtgatgaggaagtcggggagttagttgcggatgctatggaaaaggtgtctaacgacggtgttatcacaatcgaagaatctaagacaatgaagacagagttagatttagtggaaggtatgcagtttgaccgcggatatttatctgcttacttctcaacagacatggaaaaaatggtcgctgaattagaagacccatatatcctgatcacagataagaagatttctaatattcaggatatccttccaatcttagagcagatcgtacagagcggaaagaaacttctgatcatcgcagaagatattgaaggcgaagcactgacaacattgatcgttaataaactgcgcggaacattctctgtgtgtgcagtgaaggcacctggatacggtgacagaagaaaagcgatgttagaggatattgcaatccttacaggcggaactgtgatttctgaggaagtcggattagatttgaaagaaacaacgattgatcagttaggccgtgcaaaatctgtaaaagttgaaaaagaaaacacagtgattgttgacggagaaggatctaaggatgcaatccaggcaagaatcggacagatcaagggtcagctggatgagacaacttctgaatttgataaagaaaaattacaggaaagactcgcaaaattatccggtggtgttgcagttatccgtgtaggtgcggcgacagagacagagatgaaagaaagtaaacttcgtctggaagacgccctggcagcgacaaaggcagcagttgaagaaggtattattttcggcggcggttctgcttatatccatgcttccaagaaggttgcaaaaatggcagaagaattagagggcgatgaaaagacaggtgcaaatattatcctcaaagctctccaggctccattattccacattgctgcaaacgcaggactggaaggttctgttatcatcaataaagttgaagaacaggaagttggattcggattcgacgcattaaatggaaaatatgtaaatatgattgaagcaggcatcattgatccggctaaggtaacaagaagtgcattacagaatgcaacatctgttgcatctaccttactgacaacagaatctgttgttgctaatatcaaagaagatgcaccggcaatgccggctggagcaggagcaccgggaatgggaatgatgtaatcggatttcataaggtgtttgattgtaaaagagatacagaaacaaagagaaggctgataaactcgtcagccttctttttttcatgacataaaaaatgcatttcagtacaaaagggtagacaaagagtaaagaaagaagtataatatttacaatttctaaaatatgtaagaaggaggcgaaaaaagttgccggaagaacaaatgataaaagacatgtataatctgatgcagcaggtgaattccagtatgacagcctttgacggacgaatgggacgtgttgagagaaaagtggatctgctgacggtaaaaacagagaatctggaagaaaaaacagatatgatcgttcaggacattcagagactggatgagaagacagatggattaagtcaggatatccagagactggatgagaaaacagacggactgagccaggatatccagagactggatgagaagacagacggattaagtcaggatattcaaaggctggataagaagacagatggattaagtcaggatatccagagactggatgagaaaacagacggactgagccaggatatccagagactggatgagaagacagacggactgagccaggatatccagagactgaatgagaaaacagacggactgagccaggatattcagagactggatgagaagacagacggattaagtcaggatatccagagactggatgagaagacagatggactgagccaggatatccagagactggatgagaaaacagacggactgagccaggatatccggagactggatgagaagacagatggattaagtcaggatatccagagactggacgaaaaaacagacagaatggaaagcagtattcaggaattaaatgaaagaacctctgctttggaagaaaaaacagatcagctggatcagacgacaaaattcctaagtgaacaaaacagccttctcttacagcgcactgatattctcacagaaaagtcaaatcttatgtcagaaaaaatagattttatatcagagaagacaaattccatagaatcccgtttggagcgaacggaaggagaggtatctgatcttaaaaccaaaatggaagctggattttccgatattcatatgattctggagaatgaaatctgcaccaaattaaatgtactctttgaaaaccgtgaagattcatccagatacaagatggttataagaagacaggatgttttggagaccgatgtcgatctgttaaaaaagacagtcacaaatcacagtgtaaaattaaacaaaatattttaaggagaaggagccggttctttctccttttttctgtgcagaaacaaggccggttttttcatttgttaagagtattttaagaatttcaaaaaaatgctttgctattgtacagtttcacgatataataaaaaagatattaaaagatgcagaaagaggtgtatttggtgtataaaatagtaaaaaaagagacacttaataacttggttgaattgatggaaattcacgcaccattcgttgcaaggaagtgtgaaccaggtcagttcattattatccgtgttgatgaaaaaggcgagagagttcctttgactatcgcagattatgacagagaaaaggaaacagtcacaatcatttatcaggttgtcggatattccacagaattattaagcaagaagaaagagggagactatgtagccgattttgtaggtcctcttggacagccgtccatcttacataaacgagagagagttttaggtgtggcaggcggagtcggtgcagcacctctttatcctcagcttcgcaaacttgccgaaatgggagttcctgtagatgttattatcggaggcaagagtgcagaatttgttatcttaaaagagaaatttgaagagttctgtgaaaatgtatttattgccacagatgacggaagccttggaacaaaaggatttgttacgaatgttctggaagatcagattgcaaaaggcgtaaagtatgacgaagtcatcgcgatcgggccgctgatcatgatgaaaaatgttgtaaagattacaaaacagcatgatattccgacgatggtatccctgaatccaatcatgattgacggaaccggtatgtgcggcggatgccgtgtcacagtaggcggagaaacgaagtttgcctgtgtggacggaccggattttgacggattccaggtggattttgatgaatgtatgaaacgtcagacaatgttcagagaagaagaacacgagtgtaagattgggaggggtaaatagtcatggcaaatatgagtccaaataaagtagcaatgccggaacaggatccgaatgttcggaataagaactttaaagaagttgctttgggatatacgaaagaaatggctatggaagaagcaacccgctgcttaaactgcaaaaataaaccgtgtgtcaacggatgtccggtcaatgtaccgattccggaatttatcgaaaaagtagctgcaggtgattttgaaggcgcttatgaagtaatcacgagtgagaatgccctgcctgctatctgcggccgcgtatgtcctcaggaaaatcagtgtgagggtaaatgtgtccgtgggatcaagggtgaacctgttggtatcgggcgtatggagcggtttgttgcagactaccacatggcaaatgcagaaccggctgaagtcagcatcgaaaagaatggaaagaaagtcgcagtcgtaggatgcggacctgcaggtattacctgtgccggtgaactgatcaaaaaaggatatgaagtgacagtgtttgaagcactgcacaagccgggcggagtactgagctacggaattccggaattccgtcttccaaaggatctagtggcgaaagaaatagaatctgttgagaatcttggcgtgaagatcgagaccaatgtgattgtcggaagatctgttaccatcgacgagctgatggaagacggatatgaagctgtctttgtgggcagcggagcaggacttccaagattcttaaatataccgggagaaaactacctgggagtttattctgccaatgaattcttaacccgtgtgaacctcatgaagggttacgaattcccagagtacccgaccccggtcaagatcggaaagaaagttgcagtcgtgggagcaggaaacgtagcgatggatgctgccagaacagcgaagcgtcttggagcagatgaggtatatattgtttacagacgaagtgaagaggaagctcctgcccgtctggaagaacttcaccatgctaaagaagaaggaattatctttaagtttttaaataatccggtagccattaaggcaaatgaggacggatgggtagagaagatggagatcgtaaaacaggaattaggagaacccgatgcctcaggaagaaggtctccggttccgattgaagggtccaactacgatattgatgtagatactgttgtcatcgcgattggacagagtccgaacccgttaatccgtcacacaacaccaggcttggatgttcagaaatggggcggtatcattgttgacgaggagacgatggaatcaagcaaagacggagtctatgcaggaggagatactgtcacgggtgcggcaactgtcattttggccatgggtgccgggaagaaagctgcggcagccattgacaaaaagttaagaggataatcgggaggacaggatatgagcaaaactatttttcaaacatctgtctatgaattgggagaccaggttgatgccttttatgacgaagggatgtttgtgctgttcggtgagaatgttccggatacattaaaggatttctgccattttatcgatgtcaatcaagtagacgggacaatcggcaaaggaaacacactggtgattgacggtgcagagtttaagatcacggctgtgggagagattgcccagtctaatttagagactcttggacatctgacggtagtattcagcggggcagctgaggcagggcttccgggaagcatctgtgttgaggccaagccaatgcctaagttaaaagtcggatcaaagatcgcaattaaagaagactagacgattgtacaaaggattattgttttcggacaataatcctttgtttgttgacaaagaatttagaatttgttatagtataaaactataaattagaatacgaaagacatagaaagcgaggaaaaaatgggaaagttaattggccagggaatcacatttgacgacgtattattagttccgggatattcagaagtaatcgcaaatgaagtggtgacagagacccgtctgacagacaagattacattaaatattcctttaatgagtgccagcatggatacggtaacagagcaccgtatggcgatcgcaatggcaaggcagggcggtatcggtatcattcataagaatatgaccattgcacagcaggcagacgaagtggacaaggtaaaacgttcggaaaacggtgtcatcacagatcctttttctttaagtcctgaacatacgatccaggatgcagatgacctgatgggaaaataccgcatatcaggggtgccgattactgagggaaccaaactggtcggaatcatcacaaaccgtgatttaaagttcgaaacagatttttcaaagaagatcaaggaatccatgacatcagaaaatcttgtcacagcgcaggaagggatcaccctggaagaggcaaaacagattttagggaaggcaaggaaagaaaaacttccgatcgtggacaaagactttaacttaaaaggtttaattactattaaggatattgaaaaacagatcaaatacccgcatgctgcaaaagacgaacagggcagactgctgtgtggtgccggtgtggggatcacagccgatatcttggaccgtgtggatgcattggtaaaagctcacgtagatgtagtggttgtcgactcagcccatggacattctgcaaacgtattaaaggcagtcagaatggcgaaaaaggcatatcctgaactgcaggtcattgcaggaaatgtagccacggcagagggtacaaaagcattgattgaggcaggggccgacgctgtcaaagtgggaatcggaccaggatccatctgtaccacccgtgtggttgccggaatcggtgttccgcagattactgcgattatgggggcatatgaagaggcaaagaaagcagggattccgatcattgcagacggcgggatcaagttttcaggagatattacaaaagcgattgcagccggtgccagtgcatgtatgctcggaagtatgatggccggatgtgatgagagcccaggagagtttgaactctaccagggaagaaaatataaagtataccgcggcatgggatccttagcagctatggaatgcggaagcaaagaccgctatttccagacaaacgctaagaaattggttccggaaggtgtcgagggccgtgtggcatacagagggactgcagaagacaccattttccagctgctcggcggactccgctccggcatgggatactgcggggcaaaaaccgtagaagaactgcaggagaagggacagtttgtacagattacggctgcatccttgaaagaaagccatccgcatgacattcatatcacaaaagaagcacctaattacagcgtagacgtttaagaactttcctatggaaaaataaaaagcagcagttataaaaattaactgctgctttttgaatgtgcaggtttactggtgctcttcaaaccattgtctgctgtcttcaagccgtttgtttacatagtcccagttgattagtgaaaaccagttgttcacataatcagggcgccgattttggtactggagataataagcatgttcccagatatcgacaggaagcagaggataaagagtatcactgagcggtacatcctgatttggaagatttatcacttttagttttccattgttatttacaagccatccataaccggaaccaaactgtgacaatgcggcctctgtcatttctttcatgaaggcatcaagggacccgaaatctctctctatggcttttccaatttctccttcgggagttgtgaattcatccttttccatagcgttaaaatatacttgatggttgtaaactcctccgccgttgttcttaacaggggtttttgcttcttccggaattttgtcaggttctgtaagcagctgttccagcgtcatgttatgcagatcttggtggggtttgattgccgcattcagtttttctacataggcggcaagatgtttatcgtgatgaaatctgagggtttcagcgtcaatcaccggctccagggcatcataatcgtatggaagcggttcgagggaaaatgggtatgtttcattcatattataatttatctccttttttctttttattttacgtgggaatctaaaataatattcaaaaaaacttgaatcctttgagcggtcatgctaacattgtattattcttataatacaaaaactcaaaaggggaaaaaacatgttttcaaaatttagtgtgcgcaagccatatactgtcattgtgggagtcatcctggtaattattctgggcattgtctctttttccaaaatgactacggacttgcttccgagtatggaacttccatacgctcttgtcatgactacctatcagggggcttctcctgaagaagtggagactacggtgacaaagccagtggaacaggccatggcaaccatatccaacatcaaacaggtggcatcttcctccagtgagaatatgtccgttgtctatatggagtttgaaggcgatgccaatatggattcggcagctcttgatatgcgggaaaagctggatatgatcaaaggatactggcctgacaaagtaggcaatcctacgatcatgaaattaaatccggacatgatgccggtgcttgtgactgcgattgattcggacaacaaagatatgtctgagatttcaaagctgatcaaagacaaagtttctccgggtgtggaggcagtggaaggtgttgcctctgtaagcgagaccggaatgcttgaagagaatatcaatgttatcatcaatgaggacaagatcaaatcattaaataaaaagattcaaaaggctttggacggccagtttgacgaggctcaggatgagctggaccgggcgaaagcaaaacttgacggaagcaaggcacagctgaattctaagagaacggagctcaacgatacccttgcgaaagcacagacggctctaaacagcgggaaattaagccttgcccagaaggaggtagaggtcacaagtgctcttaccaatcttcaaaatcagaaaaaagctttggaacttgtaaaacaggcgggggaagaaggacttaaacagctggaggcacagctcaaaactgtgacagaccccgcacagaaggcgcagcttcaggctcagatcacagagattaaaaagcagctgaaaacagcagacagtacgataaagaccctggataaaaatattgaagttttacagaaggcgttaaagcagatccagaagggcaaaaaacagatcgacgccaatctgacgacagtgactgcccagaccgccaatgccaacagccagatgacatcaggagagatcggcatcgcacagggcgaatcacagatcgctgcgggccagcagcagctggatgccagcaaaaagcaggcaaaagcggcggctgacataaaagataagctgactgtggacaatgtaaaagccatgctgatcgcacagaattttgaaatgcctgcgggatatatttcagaagacaacacacaatatctggtcagagtcggggataaagttaccagtcaggaagatctggaagacatggagctgatggatctcggcattgataactttgcgccgatccgtctgagtgatgttgcagatgtggcagttgtcaacaataaaaaggataactactgcagggtaaatggcaatgatgcggcagtgctgagcattcagaaacagaacaattactctacggcagacgtatcaaagagggtttccgagaagctggaaacactcaaaaaagagaaccccggactgcattatacaaacttaatggatcagggaatctacatagatatggttgtaggatctgttctgcagaatcttggaatgggtgcagtgctggcagtgctgatcctgcttgtgtttttaaaggatatcaaacctactgccgtcatcgcctgctccattccgattagtgtagtgtttgccgtggttatgatgtatttcagcggcattaccctgaatgttatttccctctccggccttgcgctcggagtcggtatgctggtggataactcgattgttgttatagagaatatttaccggctgagaaaagaaggggtgccggtcaaggaggctgcgatcgaaggagcaaaaggggtagccggagcaatcactgcttctacgctgacaacaatctctgtcttcctgccgattgtgttcacaacaggacttacgaagaagctgttttccgatatggcgctgacaatcggatattcactgattgccagtctgatcgttgcagtgacttttgttccgatgatgtccgccggagtgcttcacaaagtgacggaaaaggacaacaggctgtttgacggacttcagtctttgtaccgcggagtcatggataaggtgctcaggaggaaatggattgccatcgtactgacgctggcagtgtttgtgggagcagtgatcggggcaacaaggattggaacttccctgatgccgtctatggacagttcacagatgagccttaccatcgagatgccgaaaggatcaggtctgagtgatacggcggctatgtctgatacggtcatgaaaaaaattcgtgagattcctgatgtagacggcgtcggagctatggtgagcagttcatcaggcatgggaggcacttcgtcgggaagcaaggcaaatcaggatacagccagcatgtatatcatgctgaaagaagataaaaagcagacaaataaagagataaaaaatgagatcttaaaaaagacaaagaaattcgactgtgagatccaggtacaggagtcaaacatggatatgagcgccctcggaggaagcgggattgccatcgaagtcaaaggaaatgatatgaaaacgctccgcaggacagccagtgatattgcaaaaagggtggaatctgtcaaaggcacgaagaatgtcagtgacggacaggaggagacgactcccgatatccatgttacagttgataaagcaaaagccgcaaaatatggtctcacggtggcgaccgtttatcagcagctcagctccaagattcaggagggctccacagcgactacgatcagccagaatgaaaaacagtgggatgtaaaagtgtccaatgacaccaaggacaatattacaagagcacagctgaagaaaatgaagctcactggaacgaagaaaggggagagcagggaagtggcactttccaaagtagccagcttcagtgataccgacagtctctctacgatctcaagatcagctcaggagagaatactgaatgtaaccgcagagcttgaggacggttacaatatcggtatcgtcagccagaatgtgaccaaagcgctgaaggggtacaaggcgccagcaggatacagttataaagtggcgggtgagatggaatccataaatgataccgcgggacaggtaggattgatgctgattttggcaatcgcatttatgtatctgattatggtggcacagttccagtcactcaagtctcctttcattatcctgtttacaattcctctggcatttacaggaggtctgatcggactgtttgtggcgggcaaggatctgagcatcattgccatgatcggtttcgtcatgctgtccggtatcatcgtaaataatggtatcgttctggtggatacgatcaatcagctgagagataaaggctacgagatcatggatgctgtcataactgccggttccatgagaatccggccgattttaatgacggcgatcacgacaattctgggtctttctaccatggcactgggtattggatccggggcagaaatggtacagccgatggccatcgttacgatcgggggactgatttatggaactttgcttacattaatctttatcccttgtatctacctggtgtttaacagaaagaagaaaaggcagagatcctgattttcttacaaatgtattaaataaatgagcttggctttacattttgatgatggaaagctataataagacaagaatcatgtcatgtattatgacatggtttttgtttgtaaaggagtgaaatatgaaaaaactggatggttatttatggaatataattcccaaatatgcagtgctcccattgatctgttctttcacttttaattcactgatttatacgggtacacagattctgtgcagggatttaaagcattatgattttacaacggcatttgaccgtgcagttcctctgataccgggatttacgagtatctatctgatctgttatctgttttgggctgtgaattatatcatgataggcaggattgggaaggagcatttataccggttcttagtaggagatttactctccagagtcatctgcggtatcttctttgtaatggttccgacgactctggcaaggcccgaaataaccggaaccgggatatgggatcagatgctgaatctggtttatacggttgatccgtcggcaaatctgtttccgtccatccattgtctggtcagctggttttgttatgttgggatcaggggacagaaaaaagttcctttgtggtatcagcgtttttcctgtgtttttgcagttctggtgtgtatttctactcaggttacgaagcagcattatatcatagacctgataggagggatactgctggcagaggctatgtatctggtcggtcagaagacggattggtatctgaaactgcagagtatgtttacaaagatcaaccgtggtgtacatttggagagggcaatcgacaaagaggtaggttatggagaataagaagcgctggattggcaatggcatcttcttttttgcactgttcgggcttacattttatgcaatctttcgcggaaaagagctgccggaacttttaaaggttatgagaagcgtcagccctgtatactatatattaggttttgggctgatcatcgtgtttgtatgctgcgaagcttttatcatttacagaatgctgcgtgtgctccggtaccgcgtgccgaaaaggcactgcattctctattcgtttgtaggattttttttcagctgcatcacgccgtcggccaccggaggacagccggctcagctttactatatgaaccgggataagatcgatgtttcggtgggaaccgttgttttgatgatcgttacaattttatataagtttgtattagtatttctgggagcggcgatctttgtgttccggcacagcctgattacagactatatatctcaggtagcatttttcttttatctcggtatcggactgaatgttttctgcgtcgcactgatgctgatgctggtatttgaaccgacgcttgcgtccagagtgcttctgtcaatgatacggatgctggaaaaaattcatatccttaaaaagaaagaagagcggatcagaaaaatagagggctggatgcaggactaccataaggctgctgcagtcattaaagaatataaactcatgatttttgagatgtttttggtgactttggttcagagaattctgcatttttccatcacatatcttgtctataaggcgctgggactctctgcacttggagttgttgatattgtagcacttcagtgtgtcatatcgatctcggtggatatgcttcctcttccgggaggaatgggaatcagtgaaggcttgtttttaagtattttccagaagatattcaggggcagtctgctgtatccggcaatgctgctgagccggggaatcagttattatgctctggtgctgatcagtgcattcttgacttttgtggctcatgtgacaataaagcgtaaggaatagaggtttaattatgataggattttataatgtgtcagtgatactgacatatgcaggtgtcgtcagtgctgtgttcggtatgtcagcggcatttaacggaaactttaaaatagcaatgatttgtctgatgatctccggatttacagatatgtatgacggaaccgtcgcaaaaatgatcaaacgctccgatgacgcaaagaaatttggaatcgagattgattccctctgtgatctgatctgttttggagcgtttcctgtcgtcataggttattccatggggatggatgcttggtatgcaaaaatcatatatatgatgtacattctgggagcggtgatccggctggcattttttaatgtcaccgaagaacagagacaggcagagacaagcgagagaagaaaacattaccggggacttccggtcacatcggtagcactgattctgcccgtcgtatatcagctgaaaaggttttttacagcacagtttccatacatatatctgctggcagtattgatcatttctctgctgtttgtaattgatttcagtgtgtttaagccgggaaagaagtgcatgttcgcatttgtaattataggcatcctgatcgccgtcagaatatattttctttaaaggagaaaagaaatgaaatacgtggatcaaaaaggccgctgttatgaggaagaaacttttcaggataaatttctgaagcttctttatggaacttacatcggccgtatcaaattaaagattctcacaaagccctggatatccaggctgggaggtctttttctgagtacaggcttctcaaagtgtctgatcgagcggtttgtcagaaaaaataagatcgatatgagggagtatgaggacaggatctatacgtcttataatgattttttcacgaggaggatcaagcctggaaagcggctgcttcctgaaaatcaggacattctgttcagtccttgcgactgtaaagcaagcgcataccgcataacagaagacacgtcattttgtgtgaaagatacggtctataccgtggagtcactgcttagaagcagaaagatcgctgaccatttcagaaacggctacgcagtcattctgcgccttacagtcgatgattatcacaggtactgctattttgacaacggcacgaagagcaggaattattttataaaaggggcctaccacactgtgaatccgacagccaatgactatgtgtctgtctataaagaaaatgccagggagtttaccatgatgaagacggagcatttcggcgatgcagtccagatggaagttggagctctgatggtagggcggatcgtaaaccatcacgaagaaggcatcatgcaccgcggtatggaaaagggatattttgagtttggaggctccaccatcgttctgcttttcagaggcgacaaggtagagatcgatgaatgtttattggaaagaacgaaagacggatgtgagacaaaactaaaacagggccagcgtttaggcatggcaaaaaaacaaagtctgcaatcataattgtaggctttttctgttttataaattgagtcagcgggcatgattcgggatttagggaggaagaggaaaatgcttaattatcatgaactttcaaaagaactgcagaaggaaatcatcagggaccggcaggtgggctggaaaaatccctatgcatgtacggatgaacaggtgatccggaaaaatcgggaaagagataaggccagcctctggagaccggcttttgtccgggatgtggaaaagatcatccactctccatactacaaccggtatacagataagacccaggtattttcatttttcctgaacgatgatatttccagaagatctctgcatgtacagcttgtctcaaggattgccagaaatatcggtaagctcctgggtttaaactgtgacctgatcgaggcggtcgccctcggacacgacatcggacacacgccgttcggacatgcgggagaacggtatttggatgaactttatcatgagaagacaggacagtgttttcagcacaatattcaaagtgtgcgggtgctggacgggatgtttgagcggaacctttcactgcagacattggatggaatcctgtgtcacaatggagaatttgaacagcaggagtaccgtccctgccggatggatacttttgaagagttttatgagaagatgggaaacagcagtcaaaacaaagactatatcaaaactctgatcccctcaacccttgaaggatgtgtggtcaggatctgcgatatggtagcctatcttggcaaggaccggcaggatgcgaagaaagcaaagctgattgagagcagtgatatttttactcagggggagatcggagtagaaaatgcggagattatcaataacatgatcgtgaacattgttgaaaacagttaccgaaaagactatatcatgctggattcaaagtattatgatgccatgaagatcgccaagaaagaaaactatgaacaaatttatttcaacaaaaaactggactgtatttattcggaaaatgtggctccgatgttccgggaagtctatgaaaagctgtatgctgatttgatcgcgggaaatgaagaatcggtgatttttaaacaccatatagaatacgtggaggaggccaggtcttattatgatgcgtcaagatcctacgcagaggaggagccgaaccggattgtggccgattatattgcgagcatgacagatgattattttgtagatctctaccatcacttatttccgaaagggaaataccatgtgaattataagtcttattttgaaaattgatatcaataaaaacttgacaattttagaaaagttgcgtatgataaggctataaatgatattggttatcaatttatggaggcacggcagagagacagatgcgaatgggaggcagtatgaccacagaacttagccgggaaagaatcatagagcagcttcgggagcaggggcttcggattacaagccagagaaaagtgattctggatgtgattttaaaaaataattgttcctgctgcaaagaaatcttttatgaggcgacaaaaatagatcctgccatcggcagagcgactgtctaccggatgatgaataccttggaagagctaggagtcatcgaccggggaaagcagtacgagatctgttacgagggattattcgggacagagaaggatcagacgagtctgctcacaaaagaagagatgaaggaactccccaaggatatatggtatcccgccctgaaaaaaatgctcagggcccttggtgagattaaggatgaagatatttccgttgttgtaaaagtcagccggaaaagcagttaaaagtgtgtccccgctggagacagtgctgtcaaagcatgatctccggcggggattttttgtttttcaacggtgagactttatgttataatacattctaggttattttaaaataaagtatgagaaagaggtcaatcatgggaaaatattttggcactgacggcttccgcggagaggcaaatatcgatctgacagtggagcatgcatataaagtaggaagatttttgggatggcatctgggcaaggaaaagaaacgcccgaaagtagtcataggaaaggatacgaggagaagcagctatatgtttgaacatgcgctggtggccggacttacggcttcaggagccaacgcttacatgctctatgtgactacgactccgagtgtgtcttacgtagtccgcacggaacagtttgactgcggcattatgatttctgccagccacaatccatactatgacaacgggatcaagctgatcaacgccaagggacataagatggatgcggaagtcgaagaacagatcgaggcatacatcgacggtgagatcggagaacttccttttgccacgaaaagcgatatcggaagggcgaaagattacgcatctggaagaaaccgatacataggatatctcatctccctggccacacggtcatttaaaaatgtaaaggtcggactggactgttccaacggaagttcttccagcattgcaaagaatgtatttgaaacactgggtgcagaggtctatgtgatcaacaatgaaccggacggaacaaatatcaacaccaactgcggttccactcatatagagatcctgaagggatttgtaaaagagaaccacctggatgtgggattcgcatacgacggcgacgcagaccggtgtattgctgtggatgagaacggggcagaagtaaacggcgatctgatcctgtatgtgtgcggaaaatacatgaaagagcacggcgctctcaacaataacacggtcgtcacgacggtcatgtccaacctcggtctttacaaggcctttgaccgggccggcatcgactatgaaaaaacagcagtgggagataaatatgtgtatgaaaatatgtccagaaacggacacggcctgggcggtgaacagtcaggacatattattttcagcaagtttgcgactaccggagacgggattctgacttctttaaagatcatggaggccatgctggaacagaaacagtcactcggtcagctggtaaaggatgtggatatctatccgcagattcttgagaacgtcaaagtacgggataaaaaagacgccagggaagacgcagacgtgatcacagcggtggaagctgtggagaaggaactcggaaatgacggaaggattcttgtaagggagagcggaacggaacctttggtgcgtgtcatggtggaagccaaaactcacgagatctgcagggaacatgtggaccgtgtagtgaaagtcctgcgccaaaagggacacgtcatcgactgatttatggaaacattatacgcagatattatcattaatatttcgcatgaggcactggatcgggtatttcaatatcgagtgcctttttccttatgtgagcagatccgggtcgggcagtccgttcgggtgccgtttggagcaggaaaccgggaacagaggggatatgttgtcaggctttcggatcaggcagagtacgatccaaagaaaataaaggaaattttgtccatagaagaagacagtgtgagcgcagaatccaggatgatcaagctcgcctactggattcgggaaaactatggctctaccatgatccaggcattgaagaccgtgcttcccgtgcaggataagatgaaacaaaaagaaaaaaaatctgtcaggctcatgctgcccaaagagcaggctcccggtctgctggatgaatatttaggcaggcattatgcggcaaaagccaggctgctggctgctctcatggatgagcagacggtttcctgggagcgtgtgacgaaagacctgaagattccgaggacaacggttgcaggtatggaacaggacggcatcatccgcgtcgaaacagaaatgttttaccggaatcccggccccggcgggatggaagcggaggctgccctgcccctgaatgagagtcaggagaagctgatacaggaatttaaagcagattacgcggcaggggagaggaaaacgtatcttctgcacggagttaccggaagcgggaagacagaggtctatctggcggcaatcgaagaagttgtcagaaaagggaaacaggcgatcgtgctcatcccggagatcgcccttacgtaccagacggtctgccgtttcacgaagcggtttggagacagagtatccattcttaattccagactctccaaaggagagaaatacgatcagtggctccgggcaaagaatggggactgcgatattatcatcgggcccagatccgctttgtttgtgccgtttcctaacctggggctgatcattatggatgaagaacatgagggcagttataaaagtgaacagacacccaaatatcatgcaagagaagtagccctgaaaaaagcggacatggaaggcgcggcggtgattttagggtccgcaacgccgtctcttgagagctatcagaaggcactggacggaaaatacaggttctggactctgaaagaccgtgcaaaagaagcggtcctgcccgatgtgtatatagaagatttaagggaagaattaaagcaggggaaccgcagcatgttcagcagaaggctctatgaactgatcggagaccggcttcggaaaaaagaacaggtcatgctgtttttaaaccggaggggatatgccgggtttgtctcgtgcagaagctgcggcactgtaatgcagtgtccgcactgtgacgtgtcgcttacgtatcacagggacgggaaactccgctgccattactgcgggtatgaagaagtgatgccggaggcctgtcctgagtgcggcagcccgtttatcggaacgttcggcctcggtactcaaaaggcagaggccgccatcaggaaagaatttccggaagcaagagtgcttcggatggatatggataccacgaaaagaaagcacagccatgaagagatcttgaagactttttcggaaggcagggccgatattcttgtgggcacgcagatgatcgtcaaaggacacgattttgaaaacgtgactctcgtcggaatcctggcagcggatttatctctgcatgccaatgattttcgtgcggcagagaggacattccagcttttgacccaggcagccggccgtgcagggagaggtgagaaagcgggtgaggttgtcatacagacctattcgccggaacattactgtattgtcacggcggcggcgcaggactatgaagagttttaccgccaggagatagcctaccggacgatgctttgctatcctccggtttggcagatgctcacagtccttcttgccgggccttcggaagaggaatgtaaacagacagcacagcgcatggcaagggtcattcagaattcgggtatccgtgtcatcggacccggcgaagcctctctggcaaaagtcaatgatatttaccggcaggtgctgtacgtaaaagagaaagactacaaggaacttgtgaaggtgaaagaccggctggaactttggatcgaccggcaggaactgccgaaagacattcatattacatttgatttcaatcctatgagcagttattaacaaagaatatttgagatatttgagaaggagaagtattcatggcaatcagaaacatcagaaaaatgggggatgaagtcctcagaaaaccatcaaaagagattaaagaaatgacttccaggaccatgctgctgatcgaagacatgtttgatacgatgtatgaggcatatggtgtgggactggccgctcctcaggttggaatcctgaaacggctggtggtcatcgacacctatgaaggccagccgctggtcctgatcaatcctaagattgtggaaaaagacggcgaacagatcggagatgagggatgtctgagccttccggggaaggtcgcagtcgtaaagcgtccgaaccatgtggtatgtgaggcgctggaccgggatatgaaccccatcagagtggagggagaaggacttcttgcgagggcgatctgccatgaactcgaccatttggacggagtcctttacccggatgtggcggaagaaccggtgagagatgtggaagaagaggaagagtaaggaggacgcgatgaacgttgtatttatgggaacgccggaatttgcggtgcctacattggagaagctgacacaatttcatcatgtggctgcggcagtgacccagccggataagcagaagggaagaggaaagaaactttcttttccgccggtgaaagaggcggcactgaaacatggaatccctgtccttcagccggcaaaagccagagatgagcagtttatagaagaccttgaacagctggctccggatgtgattgtagtagtcgcgtacggacagattctgccggagcggatcctgaatatccccaaatacggatgtatcaatgtccatgggtcacttcttccgaaataccgcggggcgggaccgatccagtgggccgtcttaaacggtgagaaggaaacgggaattacaaccatgtatatggaaaaaggtttggatacgggagatatgatcgacaaagcggtcatcccgctggatcagaaagaaacgtcaggaacccttcatgacaagctgatggaactgggcgcagacttattgctggagaccttagaaaaactagaaaacgggacggcggtaaggacgaaacaaaatgacaatgagagttcctatgccccgatgctgagcaaagagatgggggaaatagagttcacgaaaagtgccgctgagattgaacagtgggtgcgcggactgaacccatggccgagtgcttatacggaacttggagggaaaacactgaaaatatgggatgcggacatcgtttcttatgacggagatgagagacccggcaccatcattgaagtgaccaagaaacagatgattgtggcctgcggccaggatgctttagcactcaacgagatccagctttccgggaaaaaacggatgtccgttcaggcatttttggcgggctccagggtggatacaggaacggtattaggagaataatatgcagaatccaagagaattggccttagatgttctgatgaaaatagataaaaaagaggaactgtcccatattgccatcggagagacactggaaaagtatcagttcagtgaaaagaaggaccgggctttttttacaaggctatgccagggaactctggaacgccgcctgaccatcgactatgtgatcgatctgtattctaagacgaaggtaaggaaaatgaagccgctggtgcgttcactgctccgcatgggtgcctgtcagattttatttatggatcatattcctgactccgcggcctgcaatgaatgtgtaaagctggcgaaaaagcggggattttctaagttatccggctttgtaaacggtgttttgagaacaatatccagacagaagcaggagattccgtttccggaccggaataaggattttgaaaagtatttgtctgttgcctgttccatgccggaatggatcatccgtcattttctgcgttcttattcagaggcagaaacagaaacgatcgttagttccttcctggagccaaaaaagacaacagtttcatggatggaaagcagcgggtccagagaggaactgatcgcttccctggaaaaagacggcgccaaggtggaagacggaaagcttctcccggaggcactccgtatttctcactatgattttttgagacgtctcacatcattcagggaaggccggtttattgtgcaggatgaaagttccatgctggcgggaaaggctgcagatccaaaagagggacagaagatcctcgatatgtgcagcgcgccgggaggcaaagctctgtatgcggcagacaaactccacggaacggggcaggtcttggcgcgggatctgacggaatacaaagaggaactgttaaaggaaaacattgagcgtgtgggatttgaaaatatccgtactcagatctgggatgccagaattccggatgaacgcctggcagagtctatggatgttgtactgtgcgatgttccctgttccggacttggaattatgggaaaaaagcaggacattaagtacaatctggaagaatccgctttggaagacctggtgaaactgcagagagaaatactaaaaactgccctgacctatgtgaagccgggaggaagcctgcttttttctacatgtacgatcaatccgaaagaaaatgaggaaaatttcaggtggcttgcgggacagaccggatttgagccggaagacctgactccgtttcttcccgaaactcttgacattaaaacggtgaaagagggatatatccagctgctgccgggaatacatccgtgcgacggattttttatcggaaaacttaggagaacaaaatgagagatctgaaatcaatgacactggaagaactggaacttgcggtggaagaactgggagaaaagaagttccgtgcaaaacaaatatttgagtggttccataagaggctggcatcctctcttgatgagatgaacaatcttccgaaaaacctgaaagaaaaacttcaggaaaaatatgaagctgcggaactgaaagaagtggaaacctatgtatccaggattgacggcacaagaaagtatttatttcagctgaatgatgggaatacgatagaaagtgtcctgatgaaatacaagcacggcaattcggtgtgcatttcgtcacaggccgggtgcaggatgggatgcagattctgtgcatctaccctcggagggctggaccgcaatcttttaccgtcagaaatgcttggacagatttattatatccagaaagataccggggaacgggtgtccaatgtggtcgttatgggaactggggaaccgttggataattatgaaaatcttttgagatttatcagactcttgaccgatgaaaaggggctgaatttaagtcaaagaaacctgacagtgtctacctgcggactggtgccgaaaatacgggaactggcagatgaaaagcttcagatgactcttgcgatctctcttcacgcctccaacgacgagatgaggaaatccctgatgccggtggcaaatcagtattctatggaagatctgcttgctgcctgtaaatattattttgaccggacgggccggaggatcacatttgaatacagccttgtagcagaagtgaatgacagtccccaaaatgcaaaggaactttgccgctttttaggcgggtttccatgccatgtcaatctgattccggtcaatcctattaaggagagagacttccgccagtctatgccggagtttgtaaacgacttcaaaaacatacttgaaaaaaatcgtgtaaatgttaccataagaagagaaatgggcagagatatcaacgctgcctgtggacaattaagaagaaagaagctgaattctgtggaaaaacaggaaatccgcacaaaaaaggagaactaagatgcaatccgttggaacttctcacagaggaaaggtacggtctgaaaatcaggacaccatctttcactctgatgaacccgtaggacaattagataatttatatatcgttgcggacggcatgggaggccacaaggcaggaggttttgcgtcctcttttgcggtcagtcggtttgtggaattaatacgagagatagagaattcagatcctattgagattatgaaggaagcactgcagaaagtgagcagtgaaatattgctgaagtgccaggaagaagagtactctggcatgggaacaactatggtagcagccactgtgacagaagagagtatttttgtgatgaacatcggggacagccgtctgtattttgcagatcaggatcttgtccaggtgacaacagaccattcttttgtggaagaattggtgaaggccggagagattgaccgcagacagatgaggcagcatccaaaaagaaatctgatcacaagagcgatcggtgcagggattgaatctgtacccgatttttttgagctgccgaagaaaaacggatatttattgttgtgcagtgacggactgacgagcatggttgcggatgatgaaatcaaagaactcctgttggatcacagtcaattagaaaataaggcagcccagttggtgaacagggccaacgaatatggcggcaaggacaatatatccctggtgatcgttgcgctgggggagcgaggtgagatcacatgttagaaacaggaaccattttaggaggacgctatgaaatcctgaaaaagatcggtaccggcgggatggctgacgtatacatggcaaagtgccataaactcaaccggaatgtcgccatcaaagtgctgaaaaatgaatatgtagataatgagaagtttttaaaaaaatttcaggtggaagcagaggcggtcgcaagactggcccatcccaatattgtgaacgtatatgatgtaggtcaggaaggcagtgtcaattacattgtcatggaattggcagaaggcattaccctgaaggaatatattaagaaaaaggggcatctttccgcgaaagagactgtagaattatctcttcagatagcttcagcgatcagtcatgcccatgggcaccacacgatccacagggatattaagccgcagaatattctggtctcagattccggtcaggtaaaagtcacggattttggaatagcaaaggcggccaactccaatacagtcacatccacggccataggatcagtccattatatttctccggaacaggccaaaggaaagtactgtgatgagaagagcgacatttattccctgggcatcacgatgtatgagatggccacgggccaggttccttttgaccatgaaaatggggttaccattgctctgatgcatctccagaatgagattacgcctccgggggaactgatcggagatatcccggaaagcctggaaaagatcattctcaaatgtaccatgaagaagccggaagaccggtatcagtctgtgaatgaactgatcgaggatttgaagctggtttttgaagacacgaaaggaagctatgtaggcatggtgccctttgtggatgattcaccgacgcagctgcttcatacaaaagagtttgtaaaacaggaggagacagaagaagaaccggaagaggaatctggatttgtggatgacgacgatgaggaagagccgcggggcatgaattccaagatcgaaaaactggttgtcgtcctggctgctgtggtgggagccattattctcatatccatcattgtgctggtcattaacagttcagggctgtttcgctcaggggacaatgccggcacagagaaacttacgactaccgaggaaagcaccacggaagagcttgagaaggtaccggttgaaaactatgtgggaatgacttacgatgctgcgctggcgtccatcgatgaggacctgaaagtggagcgcaaaacagaggcttcctcttcttatgaagcgggatatatcatccgccagagtctggagtctgaccaggaagtggaaaagggtacgaccattgtattgactgtcagcaccggcgagagcaaagttgaggtgccggatgtccgcggatacagccagaagtctgccacgaagattctttcagaccagggattcaaagtttctgtgtctaccaaattcagctccagtgtcaaggaaggtgatgtgatttctcagtctcctggagcggggaacaaaatttccagaggttccaaggtgacgatcacggtcagcaagggtgagaacaaggtcacagtgccggagatcgtatttaagaccgtagaggatgcgagagaagagttaagcatagaaggattaaagctgattgtctcttcccaaaagtacgacagcagggtgccggagggatgcatcatcagtcagtcaccaaaagccgggaaaaaggtcacaaaaggaacaggaattggcgtggtcgtaagtcttggaaagcagccgacaacagaagacaccacagataatacagaggagtaagatcagttcatgcagggaagaattatcaaaggaattgcagggttttattatgttgacacgggcaccggtttatatgagtgcaaagcaaaaggcattttcagaaaccggaagatgaagccgctcgtgggagacatggcagagatcgaagtcctggatgaagaaaaaaagctgggaaatctgacagagttactcccaaggacgaacgaactgatccgtccggctgtgtcaaatattgatcaggcgctggttatttttgcagccaagaatccaaaaccaaattataatcttctggaccggtttttgctcatgatggagaagcagggagtccctgcggtggtttgttttaataagacggatcttgcaaaagaaaaagaactgtctgttctcatggatgtatataaagactgcggccaccgggtgatctttaccagtgtttccggagagacgggactttcggagatcagggaggctgtagatcacaagacaactgtgcttgcaggcccttccggtgtaggaaaatcttctatgatgaatcttttatatccggatgcaaatatggaaaccggagcggtaagtgaaaagatccagagaggaaagcatacgaccagacattcggagctgatccgggtgggagaagacaccttcgtcatggatacgccgggcttcagctctctgtttgtggatatgttcgaggaagacgagattaaatactattttaaagaatttgaaccctatgagggacaatgccggttccagggatgcagccatacccatgaacctggctgtggtgtcaaacaggcgcttgatgaagggaagatcagtaagacacgctatgacaactatgtactcatctacaatgaattaaaagaaaagagaaaatggtaatgcatatcttgattttaacaggcggagatttggacagggtcttcgcccgttcttatattcagacacagaaatttgataaagtcatcgctgcggacaaaggactgttctatgcagaacagatcgggattcgccctgattttattttgggcgatttcgacagttgtcccagagaaacggtaaaaaagtttgaaaaagaaaacattatggttctgccgagagaaaaagacgacacggatacagggatcgccatggagcaggcagtccgcatgggagccgataaagtgacggtacttgggagtacgggaaccaggctggaccatgtactcggcaatatgggacagctcgtctatgcgttaaagcatggagtggaggcatatatggtggattcacataaccgtatccgggcagtggaccgccccctttgtatagataaaaatgaacagtttgggaactatatttccctcattccggtgggcacggttacaggagtgacacttcacggattttattacccgctgaatgacgatacgcttctgtttcatgagacatgggggatcagcaatgaactgactgaggagaccggaatcgttgaaatgaagacagggaccctgcttgtggtagaaagcaaagactagatgaggcggggtggacgagttttttaccactatttccgtcacgctttaaaatgcgttcctccaatagtgctaaaaaactatcgttagatagtgactgcagtttaatgagtccttatccagcagacattacgtccattttctacatggttggagtgaggcattctaagagccgaacggaaattatgtggaaaatgtctctcgagttggacgtgcttcgcacgataaggtatacccacagggcacaccgtatttcatacccttcgggtggacgtgcttcgcacgataaggtatacttgttttagtgttgcttattttttatatttggagagggttgatattatgaaaaaaggtttgatcatggatatggacggagtcgtcgtggacagtgagcttgtgtatgtaaaaaaattcatgacatggtttaaaaagcagggtatcgagatgggaatgagtgattttgagaagatcattggcacaccgtatgcggaggctattgattactttatggagttttggggagacaggaccagcagggaagagtttgccgagatgtttgctcagctgaaagatcaggtaaaatttaactatcgggatattctcaatccgggagtgaaggagctgcttacatactgcagagagaaaaagatcaagacaaccctggcttccggaaattctatggactgtatcgaaaaaatgctggaggagtgcggtctcgaaagtcattttgattttgtgatcagcggagaaaagctgcggagaaataagccccatccggatgtctatttaaaagcaatggaatatatggacctggagccggaacagtgtattactctggaggattccagggcaggcatccgggcgtccaaaggcgccggaatttttacggtggcaaaggtgccggaagaatattgtctgccgcaggaagaggcagataccaaagtgaagcgggtagtggatgtgattccaatgctgaaaaatgcgtagataatttacagaggtgaaaagatgaaattatataaaaaattagaaaaagtactgtggcttgtcctgatcctgatgtttgcattcagtctggtgtttgactgggtaaaaaattttgtgggatccagtgttgagtttacggatgtggcatttatcctgacagtgatcagcggagctgctctgctcctagaacggttcctcgtgggacccggtacgggcaaaaattatacgaaaacagagtcatttgcacttcttttagtctttgtttatatgtttgtaatgatgtttcaggccaggggaattatgacgatttcatttttgggaaatgatcagagatcactctggatccttgcaccggcgctggcgcttttatggtttacaaagaccattgccccggagatcgagcagaaggataaagaacgtatcgaaaagaaaaagaaaaagtttaagaaccgggccagatagcaggatattcttatcggctggaggagatggatatgaaatatgataaatgtccgatctgcaatgaaaaattaaagaacggcatctgccctatgtgcggttatgactttaaaagactggagagcgggcaaagatccggaaacagggggaaccgtccggattacagagccaggcccaacgaagagccaaagcactctatgacaaaacagcataaacaggcacacagacagttccgcaccgagaaaaaaagaggtgcggggaagcttataaagtttattctgagtttcgtggttatttccagtatatttttggatgcggtaagtgaggttgatatcgggcagctgatgaaaaaggtccggacttttatgagtgaagatgaaaagaaacagtggacaaaaacgatgccggaccatacatatgaagatacggattatgatctggagaagaccggaaagaggttttctgtgaaccttacttccggcagatacatcgtaggattggatcttccggaaggaaactatacaatgaccgcaggaggggaggaactgtatttttcagcaaataatgatgcacagaatatcggcatttacgaacagtttacagatgaaaaaatattggatgtaaagcggtactgtaaagtaaaaaacgtccgtctttatcagggctctttaatagaagttacaggcagggggcatattaactgcgagacatcggatgctaatatgaagaaaatggaagaacccaggaaaaatcctctgagtaaagaagtagaagttgacggggtgatgacagcaggaaaagattttccggcaggcacttatgatgtagttgcggtcagcgatggtggtgaattcaaatttacttatgaacaagataaggatgacgaatttggtgcaaatagtatttggctctcagaagattcaaagggggaagatccagaaaaatttgtgaatttagaacttatgaaaggcacggaaatcgaaattccaccggaaggatattttcaggtcaggctgattccgagcaaacatgtcagacctgaaaatatgcatgtctatgattcgttaaatgggcttgattcataaaattaactgtgttatgattaaaaatcatagtgggagaaaggcagtgaaaaagactcaaggcaaaaggaaccttacagggaggaaagcccgcagactgaaagctttccagggacaccttgcggcgggaacactttggagctgggcggctgaaaggcaggatgcctgttaggcggtcacgtggtacgcgttaagtacggaaacgagaggaagccagaatatgaatagagattctggttttaagacgggtggtaccgtgggaagatattcccgccccgaagcaattttgctttggagcgggatttttaagttcacccaccctttataaaaggaggaaataaaatggcaaatcacatcagtgatgaaacgatcgaatacgtcggcattttggcaaagcttgagctgtccggcgaagaaaaagaacaggcaaagaaggatatggaaagtatgctggactatgtcgacaagctgaatgaactggatacggacggtgtggaacctatgtctcacgtatttccggtaaacaatgtattcagagaagatatcgttaccaatggagatgacagagaagagattcttaaaaacgcaccggagagaaaagacggcgcctttgtggtgccaaagaccgtagaataggaggaagccatgggaattttagatttgacagccctggaactgggcagaaaaataaaagcaaaagagatcacctcagtagaagcagtacaggctgttctggaacaaatcaggaaaacagagccggcggtgcatgcctatgtatcatatgatgaagagagtgcattaaagagagcagaagaggtgcagaaacagatcgatgacggcacattgaccgggccgctggccggtgttccgatggctgtgaaagataatatttgtacaaagggatataaaactacgtgcagttccagaattctggaaaattttgttccgacctatgccgctcaggcggtggaaaacctgatcgctgccggtgtggtcatcataggaaagacgaatatggatgagtttgccatgggaagcacgactgaaacttcagcatttgggccgacaaaaaatccatggaatcaggaacatgtgccgggaggatcttccggcggatcggcagcagcagtggcggcaggagagtgtttcatggcactcggctcagataccggaggatccatccgccagccggcatctttctgcggaattaccggaatgaaaccgacctatggtacaatttcaagatacggactgatcgcttacggttcttccctggatcagatcgggccgatggccaaagatgtatccgactgtgcggctcttctggaaactgtggcatcgtatgacaaaaaagactccacatccattgagcgggatgagtatgattttacatcggctttagttgacgatgtgaaaggaatgaagatcggaatcccgaaagactatttcggggaaggactggactctgaagtcagggaagctgtcatgaatgctgcccgtacattggaggaaaagggagccgtcattgaggagtttgacctggggctcgtggattacgccatccctgcatactatgttattgccgcggcggaagccagttcaaacctttcacggtttgacggtataaaatacggataccgcgcaaagggagcagagggactccatgccatgtataaaaagacacgttccgaaggattcgggccggaggtcaaaagaaggatcatgcttggatcttttgtcttaagttccggctactacgacgcgtactatttgaaggcactgaggacaaaggcactgatcaaacaggaatttgacaaggcatttgcctcttatgacctgatcctcgggccggcggcacctaccaccgccccgaagcttggggacagtttaagtgatccgatcaaaatgtatctcggagatatttacacgatttctgcaaacctggcaggactgccgggaatcagtgtgccgtgcggaaaagacagcaaaggactgccgatcggtctgcagcttttgggagactgcttccaggaaaagaaactgatccgggctgcctatgcatttgagcagacgagaagttatgaagcaccagaaattgccaaaggaggtgttcagtaatgagtaaacaatatgagaccgttatcggactggaagtccatgtggaactggcgacgaaaacgaagattttctgcggatgcagcacagaattcggaggagcgccgaatacacatacctgtccggtgtgcaccggaatgccgggttctcttccggtattaaataaacaggtagtcgaatatgccgtggctgttgggcttgcgaccaactgcagcattacacagaactgcaagtttgacaggaagaattatttttatcccgacaatccgcagaattatcagatttcccagctgtatcttccgatctgccgggacggacatgtggagatcgaaacggacggggggacaaaatccgttggaattcacgagatccatatggaggaagatgcgggtaaattaatccatgacgaatgggaagactgttcccttgtggattacaaccgttccggagtgccgctgatcgagattgtctcagagccggatatgcgttccgctgatgaagtcgtggcttatctggaaaaactcagactgatcatccagtatctcggcgcctccgactgtaagcttcaggagggttccatgagagccgatgtcaacctttctataagagaggcaggagcagaagagttcgggacaaggacagagatgaaaaatctgaactcttttaaggcgatcagacgtgcgattgaaggagagacggaccgccagatctctctgctggaagaaggcaaagaagtgacgcaggagacaagacgctgggacgatacaaaagaaaaatcttatcaaatgcgttccaaagaggacgcacaggattaccgctacttcccggaccctgatctcgtgccggtcatcatcagcgatgagtggatcagccagataaaagaggcacagccggaactgcgggatgaaaagagaaaccgctataaagaagaatacggccttccggattatgatattgacattatcacgggaagcaaacatctggcagatatttttgaggcgacgatcacccacggagccgaggcgaaggaagtatccaactggctcatgggagagacaatgcgtctggttaacgattcggaaatggaccttacagatctttctttttcaccggagcatctggcagccctgatcagcatggtgaaagaaaatgagatcaaccgaaaggtcgcaaaagaagtctttgagaagattttcaaagaagatgtggacccgaaagcctatgttgaagagcacggattgaaatcaatgaatgacgagggggctctgaaagaaaccatcggacagatcgtcaaagacaatccaaagtcagtggaggactataaggcaggaaagaaaaaagccatgggattccttgtggggcagactatgaaagcaactcaggggaaagcagatcctggagttgtcaataagatactgaaagaaatattagaaagtttataaaaagaacagaagctttggtatgattgtcatccaaagcttctgtttttgtataaaaacacaaaatgttaagaaatttttcacaaattggttgggaattctgaaagagaaatccggtatgataacagtatcacataaaatacaacggaaaaacaaatcagaaggagcgttatcatgaaggatttttacaggtcgatgtttctgctttcccttggaataaccctgattttgatcatgcaggtgcttatgatgtaggataccgcttgaaatgggaattaaaagaaagtacaatagtattggttaagtaaacgagcacgatcaataaggagaagagccatactatgaagaaatataaaggagcggtattttttgactacgacggaacattagtcgatgaagtggatcatatcaagacggttacgccgaaaaccctggaggccatcagaaggcttcaggataacggctatgcagccctgctttgttcagggcggaccaagcggtttttagaggcggatatcgagcattttgacggggccgtcacctgcaatggaagctatgcggaagtggacggggaagtgctcagggatatttatattgaggaagatctgctgcatgaagtcatagacaaatactttataagagatacgatcatccagatggatacccaggatgtaacctattatttacataacgacgaggaattttttaagtatttctgccgtctgttcagcctgccgatggggtggtacgctccatggaagtactgggaaaagcagcacatatcaaagcttacgatgaattataaagcaccggatgtttttgaggatttcaaaaaggaatacgcagataccttcgagtgtgcgaaacatgtccgtgagaatttctttgacattacgctcaaaggtgtcacgaaaggagacgcggttgtccaggtagcggatgatcttggcatttccaaagagaatctctatgcattcggcgattcagacaacgacgtggagatgcttaaaaatgtcgggaccggtatcggaatgggacgctgcagtgacgcggtgaaggagaccgcggatatgttcacccagacgacaaaagaaaacggtatctatcatgcgctgagagaattagaattaatataaaggtggaagcagatgaaaaaaattgtcgatgacgaccgtctgatttataaatgctgcaatttatactatatgaaaaataagacccaggtggagatctgcaataccctgggactttccagggccaccgtatccaggatgcttgctctcggaagagaacagggaattgtaaaaatcgaggtcatcaacccgatcagttacgattacggggaactggagcagaagctggaacagagatttggactgaaagaggccatcattgtggagagcgaaccgctggatacgaaagaggagcagatggacatgctttcagaggcggcttttgactatctgagccatattctcaaaaatgatgactatgtaggagtcaccatggggcggacgctttaccacattgcacacgttgataaaacttataacaaaggcaataagcttttatttgtgcccctgtacggcgggatatcccagaaacggacggaaaaaagggatgtacagtccaaccggatcgcagtggaatttgcggaaaaattcggcggcgattatgtccagtttttgtcgcccggtatcttttccagcaaagaggtgaaagacatcttccttcaggaggagacggtgaactacatttatgaatatttttcaaagctcagggtggtggtcatggggatcggaatcccggaggccggaggaacagctcttgtggcagaagggtatttaacggagaatgaattaaagaattttgtcgagatgggggcggtcggagatgcgtctctgtatttttacaacatcgaaggaaataccaaaccgtttgattcttttaatcagcgtgtggcaggcatatcacaggaacagctgaagaagattgacattaggatcggggttgcaggagggattgaaaaatccaaatctgtcgtcggagccgtgcgttccaaaaatattaatgtcctgatcacagactctgaatgtgcaagacagatgctgaaagaagtttgatatttgaaacatcatcataagttcatataggataaaagtaaggaccttccggaaccgcagaattccggaaggtcttttgttgtgctgatatgtattgaaatgttgtataaatatgggactgatatgaaatacttatacaatatttcaataaaaagtatagactatataataataaaagagttaaaatacatgtacagaaaaaaagatcaaagaaaggagagaaaatgtcaaatcatgtattgattctttttggagtgtttctagtgctgtttctgcttcagtctgccggagggatttttcagatcaaagattatgagaaagccgtgcggagagtaaaccgggacggagcagtagggatcggacagaaaagaggacgtctgttatccggaggccatattgtcattcttgcatgcgatgacggcggaaggatcaccggcggagaagctatggacggaatttcatttctggccagattccatccggtgtctgaggtttatcatgtgcggatactgggaagggatgttcgggaagtccttttggaactccgcagtatgacgaagaagaaacagaaatactataaaggatacatacaggcactggaagcattggaaatgagagcgtaaggaggaacatatgcaggttatatctaatttagcgaatggattcatgaagctgttttccacgggaggacagacgtttttaagctgggtgactacgattattccaacggtagtatgtctgatgactgcagtcaatgcgatcataaaactgatcggagaagacagggtagaaaaattttgtatgaggatcaccggaaacaggctgtgccggtatttatttctgcctgtcatcgcaatgatctgtgtcggcaacccgatggcatatacgtttggaagatttgtagaagaaaagtataaggttcctttttttgacgcggccatcagcttctgtcacccggtgctgggattctttcctaacgccaacgccggcgagctgttcgtatacatggggatcgccgcaggcattcaaaagctgaatctgcctctgggtgatctggcggtccgctattttcttgtaggacttgtcgtcattttcatccgcggtatggtgacagaaagaatttatctgatgctcagcaacaaatatcagaagatgggaaagaaggaggtagctgtccatgaataagccagtaaaaatcgtcgcaggttccggaggatacgggggaccgcttgtagtccaggcaacagaaacatgcaataagattctttgtatgacagcgataggaggcattcatccgctgggggcaaaactggcggagatgaccggaggggaagctgtcgacggccacaagaataacgtgccggatgaagaaatcctggtggctatcgtagactgcggaggaacgctgcggtgcggaatttatccgcagaaagggattttcaccatcaatttaaatcctgtggggcagtcagggcctctggcaaaatatattactccggatatttacgtgtctgctgtgaatgaaaattgtctgtcttatgctgatggtgaagctgtcacggagaagaaagagcccgaagaagaaagagacggcagccgggaaatgaaacaggaacagacggctgaacgtccgggattgatcacgagactcggcatcggagtagggcaggttgtcggaaagttttttgcggcaggacgtgaaacgattgaaatggtagtaaagaatatccttccgttcatggcatttaccagcactatccttggaatcatcacagctacgggacttgggaacgtcattgctaagacaatttcgccgttgtgtgccacgcttcccggaatgctgatcatatcacttatttgtgctatgccgtttttgtcaccggtgctcggtcccggagctgttatcgcacaggtcgtgggaactcttctgggatcacagatcgctatgggcaagataccggcccaatatgcactgccggcactttttgcgatcaatgcccaggtaggatgtgatttcatcccggtggggctgagccttgcggagtgtgagtcagaaacgatcgaattgggtgttccgtctgttttgtattcccgtgttattactgggccgctggcggttattattgcgttcgctgcaagctttggactatatcatggatagaaaataatatttatacataatttcaatcttttatatagactttgcttaaataaaaaggtaaaatgaagacataaaatcaaaggaggcagaagtatatgaagatttcaattggatgtgacgaagcagcttatgagttaaaagaggccatcaaaaagagactggaggagacagggcatacatatgtggacaatggagtagaggccggagaaaccgcattgtatccggatgtagcagtaaaaacctgtgaaagagtggccagcggtgagtgtgacaggggaattctcgtgtgcggcaccggcatcggtatggctatgacggcaaacaaggtgccgggaatcagggcagcggtctgtcacgatccgttttctacagagcgctccattctgagcaatgacggaaatgtgatgtgcatgggagccagggtgatcgcacctcagctggccttataccttttggacatttggatggggcttgaatttaaagacgggccgtctaccgaaaaggtcgagaggattacttattacgagaaacaattcagcaaataggcaggaggagagcatatggatgaagttttaaattattcaatgaatgaaatggcaggagcagattttgactgcagctgcggcagacatcatacactggatatcaggcatatcatcatggggcagggggttctaaaggaacttccgaaagtactggagccgttttccggcaaaaaggtttacatgctcagtgataatcacacatttgaggcagcgggagaccgggtgctctcgattctggaagccgaggattatcttgtgaaaaatgtaatgctggattccggggatgatatcctgatccccaacgaacaggccgtgggaacgatgttcctcaatctggagccggatacggcagtgatcgttgccgttggctcagggaccatcaatgatatggcaaaatatatgtctgcgagaacaaagattccatatgtgatcgtctgtacggctccctccatggacggatatgtggccgacggggcaccgctgattctggagggaaggaaaatatcctttgtcgccacacttccttacggcgtcatcggggacacggatatcatgaagcaggcgccgatgcatatgatccacgccggattcggcgatgtgctgggcaaactgaccgcccttgccgactggtatctggcaaaagaaaatgtggatgagtactgctgtgagacctgtgtgacccttgtgcagagagcactggacaaagtcacaggcagcgcagaagccctggcaaagagggacgatgacgcggtcctttacctgattgaagcgctgaccctcacaggggtggctatgggtctgatcggtgtatcccgcccggcttcaggggcagaacatatgctcagccactactgggagatggactttatcgccaagggaaaattcccggaactgcacggcatcaaggtcggcatcgcgacgccagtgattgcggaaatatttgaactgatgaaggacgaggtgccagaagaagccatgaaactggcgccttccagagaatatgtggaaggcctcttaaagacagtgggagcgccggtatatccgacgaatatcggaattgacagagaactgttttataacagcattttggagggatacaaggtaagaaaccggtacagtattctggaactggccctgaaaacaggaaaactagaagaaattgcagaaaaaataaccaaccgtatttatcagtaagggagagatgaaatgaaatattttacaagaatccaaaagctggggaaagactcgctgacgtttttaggagatcctgagtcaaactttatcattctgtttaatgataatgcgccgcctgcatttgaggatctctgtgtgctgcatacgattgaagagctgagagccaatattgagcccggagatatgatgctgattaatgaaaaaggatttgaagtgacggcagtgggtacagaagcaaacgagactctccggggacttggacattgtacggtaagctttaagggcggcccggaagcagagcgcccgggatgtattatggtggaggcggtaaaaggtgaggagcctttgacatctgcagattttgcaccgggaaatacgattgaattcatatgacattttgaccagttttccggcttgctgtctcagagatgtaagattttctaactttcatcaaagtctctgcggcggcccgttcggaactcgctgacactggcctagagtacttagggaaggcaaacgaagtgcggactgagcttagtacgaaggccgttcgaaggaacttaatgagcaggagccgtaggcgaagtgcgaatttagtgaattgaacctcattgtctccgagcctttgctgaaagaagaaaaactaacatctcttcgaatgcaaggcctccaaactggtcaaaatggacgtaatgtctgctggagcaggttgcaaagagtcaaactcatagatatttatacaaatgtatgtataaattcaattttaaaagtatttatacaaatgttcaaaataaggtatggattttatcatagaatggaagtaaaatgaagttatattaccagtggtattatttttgttgcaggtggtaactatatttgaaagtaagattcgggaggaagcgaaatggatgagatcttaaactattctatgaatgaaatggcaaaggcaagttttgactgcagctgcggaaggcatcatactctggatatcgacaagctggtgatgggccagggagtgatcaaagaactgccggaaatggtgaagggccttggcgcaaagaaagtctacatgctgagcgacaacaatacatacaaagcagcgggagaaactgcggaaacactgttgaaggatgcaggatttcaggtgaaaagtgtggtactggattcaggggaagatattctgatcccggatgagcaggctgtgggaaccatgttcttaaacctggagccggagacggatgttttaatcgcggcaggttccggaactttgaatgatatggtaaaatatatgtcagccaggacaaagatcccatatatcgttgtctgcaccgcaccttccatggacggctatgcatcagacggagctcctctgatcctaggaggaaagaagatttcctttattgcaacccttccttacggtatcctaggagatacagacatcatgaagcaggcgccgatgcatatgatccgcgccggattcggggatgtgatcggaaaacttaccgctctcgcagactggtatttgtccagggagatgaccggggaatactgctgtgagacatgtgtgactctcgtgcagaaagccctcgataaagtaaccggaagtgcagaggcacttgcagacagggacgaagaagcagttctctatctgatcgaggcgctgacgctcaccggagtagccatgggactgatcggcgtatcccgtccggcatccggagcagagcatatgctcagtcattactgggagatggaattcatcgcaaggaaaaagtatccggagctccacggaatcaaagtgggcatcgctacaccgatcattgcggaaattttcgagatcatgggtgacgaaataccggaggcggcaaagaagctggcgccttccagggaatatgtggaaggacttttaaaaaccgtaggtgcgccggtttccccaaaagaaatcggaatcgacagggatctgttttatcagagtctgcttgacggatacaaagtcagagaccggtacagcgtcttagacctggcagtggaaaaaggaaagatgcaggagatcgcggagaagatcacacatcgcttttatgatgaagattaaggagaaagacagatgaagcaaaatattcaggcagtgaaagatatcaaatgttttgtcctcgacatggacgggaccatctatcttggaaatgacttgtttccgtttacacaggactttttaaagaaagtggaagacacagggagggagtattatttctttacgaataattcttccaagagccagcaggcctacatagataaactttcgggaatgggaatatccattacaccggagcaaatgatgatttccagtcatgtaatgattcagtatttaaaaaagaatcatccgggggaaaccctctatgtggtaggaaccccttcgctgttaaaagagtttgaagcctttgacatgccgcttgtggacgaaaacccggatatcgtgatccttggatttgatactacacttacttatgagaagatttcgaaagcctgtcattatgtgagaaacggctgtacctattacggcatcaatccggactggaactgtccgatggaaggcggaaacttcataccggactgcggttccatggcgaagctggtggaggcatccacgggacgctttcctgaattctttgggaaaccttccaagcatacgctgaattattttgtggagcagtcagggtaccgcccggaagagatcgctatcgtaggcgaccggctgtacacggatattgcagtggcggacggaagtcccgtgacttccatcctggtactttccggggagagtactttggaggatgtggagaaaagtgatgtgaagccggatgtgattgtggattcattggaggatatcacagaggtactttagctttcattgatttcagccatgccggatgttataatggagacaatcaaaggaggaactcattatgacaaaaaaagaagcatttttcttcggcggattctggctctggatgggtgtggtcatcggttttttgatcgctccgattaaaaaaggagtggagatcggcaataacaatatgtgtgacaacaacacttatgaaggcagaaaaaagaaacctgagccggacaaaaagcaccataaataatgaatacccttttggagccatggttgaggttccgaaagggtatttttacgtcctattaaaatttctcagatgaaactttttccctgacggctgcccgtctctttcatgcgccgggaaatctcattcaatacttttcttttgttgagcgtccagcggggagcgatcagcagatctttgggtccgtcccctgtcaggcggtggatgacgatatcttcccgtagttcttccatacagcggatgacgagatcaacatagtcatcgaggtcatataccggaaatgggttttcttcgtacagcatgccgagatcagtgtgtttcagcacatgaaggagggaaaacttcactccgtttaccggcagctggtttaaataccggacggactgaagcatcatctcttccgtttcacccggcagtccgaggatcaggtggacgacaacattgatccccagatcgtgcagtgcttttactgcctgttcaaaacaggaaagaggatagcctcttcggatgaattgtgcagttttctcatggatggtctggagtccaagttccacgaagacgggttttatctgattcagttcatcgagcagtttaagcacgtccgggggaagacagtccggacgggtccccacagccagtcccacaatttctttccttaaaatcgcatcataaaaaagagaatgaagcttttcatatggggcataggtattggtaaacgcctgaaagtaggcgatatattttgatgcatctgtcttttgcctgatcatgcggatgccttcttcaatctgttcaccaatggggagaacagcgtcgggtgcaaaatctccggagcctccttcgctgcagaaaatacagcctctggttccaagggtgccgtcccggtttgggcaggtgaagccaccgtttaaagatattttgtatactttttctccgaaggtctgctttaaataagaattaaaagagtaataacgttttccatcccaattcataagatgcggttcctttctgctgtgtggtatagttccatagtttcttcacatattgatcataagcctttcaaattcttcctatatgataaaaacatctataaaagaaggatagggaggcttatattcatgaagaaaaaatggaaggatatcatggttatgataccgggaaaaatgaaaaaacacaagaagctgacggccgctttgttggttttatttgtgttggccggtgtatttgcaggaagattggccttgaccaggaaggcaaaaggcgggaatcagatccagactcagaaggccacaaagggaacgatcaaaaagacggtggagggaagcggttcggtggcatctgctgccacccagaccatctctttttccagtgatgtgagcgtacagtcgattaaaaagaaagacggttcctcagtgaagaaaggggataccatagcagtgctcacaagttcttcgctggaggattcgatcagcagtctggaaaatcagatctcctctctggagagcaccctttcacagggagcggagagcgcgtcaagtacgatcagttctaaagtttccggaagggtaaaacgcatttatgcaaaagatggtacagcagtggcgaagaccatggacagcaaaggcgctctgatggaaatctcggcggacggaaagctcaagatagagtttaagccctcacaaaccgtaaagacaggagacagtgtcaccgtaaaatttggagaatattcggtgtccgggaagatttccggtgtcagttccgggaaagccacagcagtgatctccgacagttactattatgatgtagatacaaaggcttctgtatataacagcagcaataaaaagctgggttcaggaaagctgaagtccaacagcccgatcacagtgacgggagacaagggaacggtgagttccattgaagtgtccaaaaatcagaaggtgtattcgggaacgacactgatcacattgagcggagcgggatattcaaaaacatacgagagcaatctggcaaaacatgaggctttggttgaccagctggaagaattaaaaaaggaaaagaagaatctgacggtgacggcaaagtatgacggagtggtggatgaactttcagcctccgcaggaaccacggtatctaaggggaaaaccttctgtaaagtggtgagtacaacagcttataaggtaaacattgatgtggatgagctggatatcaaagagattaagaccggacagagcgtatcagtgacagcggatgcgatagaggataaaacatttaaaggaacggtgaccaaagtttccaagatcgggaccaatacggacggggtagccacctatcctgtgactatagaactcagtgatgcggaggatctctatcctgctatgagtgctactgccacaattacgactcaagaggcatcagatgcggttcttgtacctgtatctgctgtacagtcaaagaatgggaaaaactatgtggcagtcgtcagcgataaaagcgaagaaggtacattaaaagaggtagaagtgggaattatgaatgattctaatgcccaaatcacttccggtatcagcgaaggtgatcaggttcaggtgattaccaaaaacacttctaataaaagtgaaggcgacaagatgatgggaccggacggcctgggcggcggaaacggaaaaggcggcggaagcggggcacccggcggcggatccggtatgccgggcgggtccagataggaggagacatatgattgaggtaaaagatttaagaaagacgtatattctcggcggagaagaggttcatgctttggacggggtctcgctgaccatcaaagatcaagagtttgtggcgattgaaggtgcttccggaagcggaaaatcgactctgatgaatatgctgggctgcctggatgtgccggattccggggaagtgatgctggacggccgtccggtaaagtcactgaaggaaaatgaactggcagccatcaggaatgagaaggtcggctttatctttcagcagttccatctcctcgccaaactgacggcgctggaaaatgtagaactgcctctgatctatcagggcatcgggatggaagaacgaagaaagacagcaatggaaaaactcatgaaggtgggactcgaaaaaagaatggaccataagccggggcagctgtccggcggccagcagcagagggtcgccattgccagggcactggcggcgggaccgtctctgatcctggcggatgtaaactgaaccccatgtgcttactgtacatagcgtgtacacagtaggattacatgacaatataggtacatgatacacaagtaatgagaaaaaatgtgtatgaagtaggaagaaagtattgatatctggtatgaggaaagacatccttgtagcaggttttttattgtctaaaatagacaggtatagagataatactttagtagtatgtccgaatagcttttttacgataagtgggtatactggtgtggtaaagagaagaggtgatgactatggcgtattgctatgatgggaaaacatatgaaacgataaaagaaatggcagaggaatatggaattgatcgtcagagaatttattcttttcggcgccgggattggtcgttagaagatgcaatgcaaatgtgcatcaatgatgtgcgaggaagggggcggctttttgaatacaatggaaagttatatcgttcgcctaaagcgttggctgaagaatatggattaccttggaattcattagcacattatatacaaaggtgcaaaacaatagaagaagcggtagatcgttgcaaagaggcacaagaaaagaaaattatgctatggggcaaaagatatcagagcagatatgaggtggcaacagcatttggaattagagagacttccatttcagccggaatccatacaagaaacaagacattagaagaaattgttcttgaactattgcagaaagaaccgatatgcttcgaagggaaaacctataatacattagtagaattatgtgcggagtatcaagtgcagccctgtaatgtttttgaacgcttaaaatatgggaaaacattggaggaagctatttatttgccaatcaggaataatgggaaaagatatgaagttgaatatgaagggaaagtatatcagaatgctgcttttttatgcagggaatataatatctccaagctgttagtatatggacaacagcgctataaaccagaatattcgtttatagaatgctttcacttagtaaagcaactgcgagatgaatgtggatggcccaaaactgaggtatttgcttttattccaagatgtaagattcaagggaaattctataaaaggatatcagattttgcatcggctgtcggcatgaccagagggcagatagatacctataaatcccgacaccatcataaaaatatgattgaagcattacaggaaatgaagaaagaccgtattccagcgtataagacggaatacggtcttttgccatatagtgaagctagaaagaaaaaatacacatctaagcagttggaacaattagaatatgtcccaagtgcattgccgcgataccctatgcttcagtcctttgattttacacaagacagtatggatatacttcttcgatatgaggaattatttcaaaagcaatcccaatgtaagagagagtggagggaacaaagataaaggagagtgggaaaagaagaggggagaagaattataggaaatgtttcttttccggtttagagaagcccggaaaagaatgtgttgatatcggtatggaagatttttgcaagagcaacaagttccgataccttgatgttcatacggttggtttccagtttcgcataagtacttttggacatagaaattcccatcagatttaactttgcaatgacctggtcttgcgtaagtttattttgataacggatggcttggatatttttgccgatatccatgtctggtctgatcttctgcatgatagagtcctctcatttcttgatgtttcgtaataaagaaactttatattgattttactgagttcactttttataatgtttcgtaataaggaattatttatgcaaaggggaatgattatgcatcagagcgatatagaacggtttgctttcctgtttttatgtggaaagcgtgacagggcaatcctgctgggaagagagaaaatgacattttcagatttggacaggctgacttatgttaccgatttccttggcctgacaagattgaacttggatatttggaatcattatggaggacaattccgggaacattttcaaagactggaacaattatatgatgaaacctgcagcattgtttcttgtgatataaccgaaattgatttatatttgcaggatagatggttacaggaattttgtaacaatgtaccagacagaaagatccggaaggaactaaaagaattagtcaaaaagatctataaggaaaagggaatggaaatcccggaagagacaggcatcatttagatgtctgtcttttcttttggaagggaggtgatagcaaacgtgagtatcagtatccatgaattattggcagtagccagggagtcggaaggtgtgaaggcagtacagggagatgccatgctatgtgaaaaacggtttgcaccggatacccggcatatggtggagtttttggtgttgaagcagacggagcagtttggggaagtgggaatatatcatcgttactttttaacaaagaaagcatattacgaaatggtggagttacagaatcaaggaatccttcgttttcaaagacaggcgcttgttttggaaggaacactgcattatcttccagtccaaacattttttcaagactagaagtaggaagaacaacaggctggaaagaaaagaatgcctgccggggtgtgcctttgggggcaagggccctttcaccggaaatttaacatagaatagaaaagaagggagtggtaagcgatgattatcggaatcgatcatggatattacgccatcaaaacaaagcaggtgtgtttccccacagggatcatccggtatgagtatgaaccctataccatgcagaatgtcctccagtaccggggagaatattatgtgtgtgggactgggagacagacattggtaaaggacaagactgccaacgacaattattatcttttgacgctggcagcactggcacaggagattcgaaagcgaaagggggaaaggacagcgaaagttgttcttgcagccgggcttccccttaccgggtttggaagggaaaaacagaaattcaaggagtatctgtttcggaaggaacagccaatccgtttcttatatgaaggggaacgctatgagatccagattgaggatgtgaaactgttcccccagggatattcagccctggctctttatccagagtatttaaaagatgagccttctgtgcttcttgttgatatcggaggctggacggtggacttgatgcggcttgataatgctgttcctaacgcagctacctgtagaagtctggaactgggtgtcatccgttgtatggatgagatcagggaacaggtaaggagaaatacagggctgtcggtaacggagacgcagatcgagcgtgtcttacatggaaaacccagcagcatgcctgcggaagtggtgtctttgattgagaggcagggcaggctttatattgaaaaaatcctgtctgcgatcaccgaggcaggctttgacctgcgggcagtcccttccgttttcatgggaggcggtgctgctatttttaaacatcgtgtaagcgagcaggaccgcctgtgtcgcccgatttacctgacggacgtccatgccaacgctgccggatatgaacggattgtggggcagatgagggcgctgtgagccgcccggtcttttccttccgcccaaaccttaagaacccggaacatgaaaaagcgtggcagcttttgatggaaattccggcagggcagaggaaccagtatctggtggatgtgatcctggaacaagaagagagggaaactttaaaaagactcattcaggaggctgttcgggaagagttaaaatgtggcgatgtggaacggatgccagcacaggaaaaagaagaaattcccggtcagatgttggattttttatttcagatggagcaggagtaaagggggtgaggcctatgggcaaggaaagtatggcattgttggatatgctttggttttgcatacatttgacatggattctttagtgggtattgtgaatagctttctttcgaactttggagtatgttgtgtataacaaaacgaaaggggaaaacgcttatggcagagatgaagaacatatgcggaaagatcccggtggaattacatgagaaggtacgagccgagatcgaagaaaaggaaacaagtacacagatatttatccgacaggtgatcgaagaacactttaacagactggagaacaaaggagaagaaagcatggaaaaaagaacattagcagtacaggtcacagaggaattattccaaagagtcaaatgggcagtcgcaaaggaaggcatcaaacagaaagatttcatcatccgcatcatcgaaaaagcggtggaagaggtagaagctaaatggcaggaactagatcagccggaggaaatcgaagaaacagataatctggaagaagcggaggatactagtgaagaagaggtggtggaatccgcggaggaagagatggatgcagaaatttctgaggatgcagaggaagaagagattccagaatccgaggaagaaaccgaagagattgcataatgccaaacacatagaactataaaaccagcgggcggtgtgggagaaaaaccatgccgtctgttttttattcagcaaaggaggttgatagccgcaaccattcgattttttgatttattcagcgggatcgggggattccgggaagggttaagacgtgcaggcggttttacctgtgtgggacactgcgaggtggatgcttatgcggataagaactaccgattgctgttcgacacagaaggggagtggttttgcaatgacgcaagaacaatcgaaactgaacgaatgccggactttgatcttttgtgtgcaggatttccttgccaggcattctctatcgctggaaagcggggaggatttgcagatgccagaggaactctgttcttcgaaattgccagactggttgcagacaagcgacctgcgtatttcatccttgaaaatgttcccggactgctttcgcatgacaaaggcaggacgtttcacaccatcctcagtacgttatctgagctggggtacggtgtggaatggaaagtgcttaacagcaaggattttggagtcccccaatccagaaaacgggtgtatcttgtcggatatcttgatcgaagatgtgccggaaaaatattacctttcccagcagcaaatggaacgtctcttatacaaatccgaacaggcagccaagggaaaagagtgtacagcccggaaggattaagctgtactttgacatcgctggcaggcggtatgggtggaaaaactggattgtatgagatgggtgttcccatcaaggagaataccaagcagggatataagatggcgtatccgggagacagcattgacttaggatatgcaggcatgaataccagaagagggcgtgtggggcatcagatcgcccatacccttaccacaggaatccagcagggaacgcttcattttgtggatctgtctccgccgcctcttgtcacagagcagtgcaggtgtctgaataccagacaatccggcatccataatcataaaggggaatgctccggtgtcttaaaagaggaaggcgccagggcagtgctgactccgggaagggaagaaacccggcagaatggccgaaggatgaaggagccggaagagccgatgttcactattactgccacagaccggcatggagttgcctatcggggcagaatccggaggctggtgccgagggagtgtctgcggctgcagggtttttatgactggcagattgaccgcatagaacaggatacttcggacagccagctttataaacaggctggaaatggagtgaccgtcaacgtgatcgaagccatcggaacgcttcttcggcaggcagatgcacaaatccgggcagaggatgaaaagacaaagaggtaaggcagtatggcaattggaattcaggatcaatatttcggtacagagattgagatgacagggatcaccaggcagagggctgcggagaaagtagcagaactgtttggaacaagggcagtttgcgacggtggatattatggggtctggtctgtgacagatcaggaaggaaagaaatggaagttcatgtatgatgggagcatttatacggaacgcagggagcgtggacgcatggttcgtgctggaagtgaatacagcaccgaaatggtcagtccgaaattgtcctatggagaaatgggaaagctgcaggaagtggtgcggtgtctcaggcatcatggggcgaaggtaaatgcatcctgcgggcagcatgtgcatgtggacgcttcgaaccatactccaagaagcctcaaaaatgctatgaccattatgtattccaaagaggatatcctgttcaaggcattgaaggtacagacatcaagggaacaggagtattgccagaaggtacgccccattgtgctggagaagatccgtcggatgccaaacaacaccatttccatggaaaagttgaaacgggtatggtatgagggcagggacggaagcaatagtcattatgacagcacccggtactatgcgttgaaccttcatgcagtattttccaaaggaactttggagtggagatgttttgagagtaccctccatgcaggaaaagtgcgggcaaatatcactttggctcttgctatctctgcccaggccatcaatcagaaatgtacccagatgcggaaaacggagatcacagagaatccggcatttaccttccgtacttttttattgcggctggggctcattggaccggaatataagaatgtccgggaacatctgcttgccaatctggagggtgacagagcatggagatatgaccgcagtacctatgaatgtttgaatcgaaatcatcgggcagaggatgcccgttaggaggtaagagatgaaagaaacctattattttgcctatggcagcaacatgaacttagaccagatggcgtaccgctgtccggcagcttccgtagtggagaatgtcaagctggagggataccgtctgaccttttgtggcagaggaaaaggaagcggtgttgccaccattttgccggaagagggcagccaggtggaaggggtgctttggaagatcacaccagagtgtgaaaaaagcctggacttttatgaagggtatccccacctgtatgggaaggagcttgttcttgttcagggaaaggatggtgtgaaacgggaagtcatggcatataccatgaatgcaccctataaggaccagccggccatcccctcggatctttattttatggggatcgtggaaggctgccatcagaatgggatttccagccgatctgtgaccgatgcgttaaagcgtaccagacaggaagtaggcagagagaaacccagtcataagaaaacagaagtcagtagataacaacgccgcaggggaaatcctctgcggtatttttaacgaaaaaaggagaatgcaatgaagagcaggaatatcaaaacaagacttgcagcctttgggctcgcactgctcatgggtcttagtccgcttgggaacttagcggatgtccatgcggcagaaacaaaaaatccgtcagagccagtgacggagagcgcagaaatatctgaaacggaacagacagagaaagtttcagaagctgtaaaatatttggtaacagcagaagatatcacgaaagatatttccgacaaggattttatggcggagacttgtatggagggtatccattacaattcagaacaagaggatgttaccttggaacgtatcgaagcggaagatggagggagctaccaccctgaccaggcaggaacctatattgcaacctactgggttgtgccaaaggatgcgcgtgacagctattctgtgagcagaaagatcatcctgacggatacggaagggcaggctcatacagaagaaaatggcggtcagaaacagaaggaggatacgaattctgaagaagattcggagacgcctgtgcaggagatcccggatgtggaagtgacggtatctggggaagatgcagatgcacaggcagcaagggagctggaagaaaagattgaggatggggaagtgatgatgctttccggtgcagaaaacacgttccgagcaagggaaaccgtacatctggaaaaaggagagaccatctactatccaagttatattggaaattacttaacctgctggtttacggtcaatggaaagatcgcttactgtctggaatcccatcgttcctcaccgccgagtggagactatgtggcacaggtactggacagcaataagaacttgcagaaggtgctgtattatggttatggcggtgccggggatattacaggcagttatctgtccgggaaaagtgcagaagagaaatatgtatatacccacatcgcagccagctatgcctatgcaggtgaggcaggatttacaggatgtaagtatgaagatctggtaaacgcaggcgtgatcgcctatattgaccacctgtttgctatggaagagccgccgaagggggaaatttctctttccaagacttctgtaaaagcagtccgaaatggaaatgtacagaaaacaccggatatcacattgtccggggatcaccgaaactacatttcagtccatgtaccaaaagacatcaccatttataacaagacaaagggaacttccgcagagaatggtgtgctgaagatctatggcggggatactttttatttgactgctccaatgcttcataccggaacctattcctccggggagctgcatggttctgtaggggaaacctggagaacactggtattatccacaggaaacagcaatcaggacattggagtctttgaatcggagaaagccaatccggtaagttttacggtagactggctggagatgacaaggatcgagcttttcaaacaggatgcggataccaagaatcctttagacggtgcagtgtatggcatttatacagacagcaagtgtgagcatcttttgatggaaatgccagtcaccggggaagagggaaaagcagtcagtgattattttgaggcagccatcaaaacagtatatgtgaaggagatcaaggctccagacaagtatgcacaaagtgatgtgatccataaggtggatgtggaagccggaaagacggtcaccatctcagcaaccgatgagagggtgaaaggtgctgtccatatccaaaagatcgataaggagacgcaggcctttcttccccagggggatagttcccttgccggggctgtgtatggtctgtatgccagagaggatatcgtccacccggatggaaagacgggggttctgttcaaaaaagacagtctcatcgcacagggcgtgatcaaggaggatggtaccttagatttttccgaattgtatctgggaaaaatgtatgtgaaagagatcactccgccggaaggctatacggtagatccaacagagtatgaggtggaccttgcttacgaaggacaggaagtggcagaggtaaccagggacctgacggtacaggaacaggtgaaaaagcaggcgttccagctgatcaagatcagcgaagatggagaccagacagaaacagaccttgtggaaggggcaggttttcaggtgtatctggtcagcagcctttccaaagtagagagtggggaattacagccatccaatggggatcagtttactgcggaagatttccgaggttatgatttcagtaaggaagaggtggcagtgacctatgtggatggcaaggctgtccccgtaccggagctgatcacagataaaaagggatatgccctcagtccggaacttgcgtatggtctttatgtggtagaagagagtacggtgccggagaatttaaaagccatcgatccgtttttggtaaaggtagatgaggatagcagagaaccgatggtatggaggatcttcgatgaccgtccatttgagtttttgttaaagatcgtgaaaaaggatgcacagacaggaaatccggtcttgaaggcaggcgcatcctataaaatctttgatatggaaaaagaggaatatgtagagcagacggtattctatccgaagaaagagacgattagtgttttcaagaccaatgaggaaggctatctggtaacaccggaagaactgaaatgttctacttaccggatcgaagaagtgaaagcaccggaagggtttgtaagacagggatatgagagttccttgtatgaagggggaaaagtgatttctccattggaggtgaccggaaaaggcagttacaaagagaacccgaaagagggaatcgtgatcactgtttcttccgataccgcccatcagatcgatccggataccggggcagtcatcgtggaagtcgagcagccaaacgatgagcaggtgggaagcctgacactgaccaaaaccggggaacagccagtggaagtgaagggggattccctgcttgcaaaggcaaagagactggcaggaaagatcaaagatgcagtgaccggagaggataccgataccggagtgttccatgattttgtctatgaagaatcaggtgtggaaggggcagcctttgaactgtatgccaaggacaccatttattccccggacggagcaaaggatgagcagggcaatccggtcatccgttatgaaaaagacgatctggtggcaactttagtgaccgatacagaaggaaaggcagtggtaaataatcttccattgggttcttattatatgaaagaaaccatagcaggcgaccatttcgtattgaacccggaacagaaagaatttaccctgaccgcagaggatgatactcaggcagttgtttatgaaggggttgcttataaaaatgagcgacagaagatttccatttctgtagaaaagaaggatgcagtcacagaagagaagctggaaggcgtgatctttggattgtatgcaaaagaagatatcctctcccagcagggtgagattcttgtagaaaaggacactctgctggagaagaaagcaacggatgagaagggacagcttacctttgacagcgacctctatcatgggaaatattatgtgaaagaggaagtgagaaagccggggtatcttccgaatgaggaaatctgggaaatcgatgcctcttacacagaccagaaccttgcagaaatcaagctgacaaaagaagtggaaaatcagccaactaaaagccagtttacaaaaaccgatgccacaaccggggaagaactggaaggggcgaagcttcagatcatcgaccaggatggcaacatcgtggaagagtggatcagcacaaaagaaccgcacgtagtttatggactgccggagggaacgtatacgctccatgaagagctgccgccttatgcagaagggtatgtgtctgcggaagatattgagtttgaagtaaaggaagatggcagtgtgaccaaggtggaaatgaaggatacctattccaaagtggaaatctccaaaacagacctcaccaccggaaaggaactggaaggagccaagcttcagatcttaaataaagatggtgaagttttggaagagtgggtaacagatggcaaaccgcatctggtagagaaacttccggtaggggaagaactgatcctgcgtgagatcacagcgccagaaggctatgagatcgcagaagatgtgaagtttacactggaagataccatggaagtccaaaaggtggagatgaaggatgcaaggacaccggaaactccgggtgtgccgcagacaggagatgaccactggaaaccaatccttctgtttgcacttttaggtgtatcagcagccggactcatggcaaccatgctctataagaagagacataaaaaagcagatgaagcaaaaaaagaagaataagctgtggacgctgcaggcagtcttgtgtgctgtctgtatcctcagtgcggcactaatttatcatgattatgtggcgattcccaggcagaatcgggaactggtggaagagttaaaaacctgcttcccggaggacatccctccgggcgggagctctccaggacaggaagaggaacaggctggaagagaaccggaagtgtctgccgttgaccttcaatccctccagcgccagtatccgggtgttcgtggctggcttacgatcccggaggttgggatcgattatccggtcatgcagagcagccgggaagaaccggagtattatctgcggagggattaccggggaaactacgacatcaatggaagtttgttcctccaggcagactgtattttgggagaatcaaagaatctgactatctacggtcacaacatgaacagcggggcgatgttcgggaatctggacaggtacgcctcctatgattactggaaagcacatcccagggtgttctttcagacgccggaaggcatggaagagtaccggatagcggcagtattgaaagccgatgtgtccatgtttgacttccagcaggcatcttttcacagtccgcaggaattggaggcttatgcagcacaggcgaaagcgctgtcgctgtttgaaacaggggtatctggtgcaggttgtgagacaagcctgacgctggtaacctgttcttatgagtggaaggaggcccggaacatccttgtggcagtaaaagcagaacctgaaaggtgaaaagtgttcaaaggtgggtactttcttcagctctctggatgtatcctgggggtgctctgaatcgctctcctgccgaaagtgtttaaaagcaccccaaaagtgcagtatgtgagacaagctgcaacgggaagtggcgatacggaacaaaaagtgttcgaagttaagggatgtgcaacaggtcgtggcatcttgtgtaatcttgtagtattgggaagtgttcaaagggagatgcttttccagctctttggtggctttctggaaccgtatattccggggagtgtttgaaagtacccgaaaagtgcagtatgtgagatgcgactgcaagcaaaagacagaacgataacctaaaaagtgttcaaggttgcggggtgtgcaacggaacgtggacaggtgtagtgtcggaaagtgttcaaagatgggaacttttgcagctatctggatgtatcttccagttatctgaaatatattttcaagaagtatttaaaaatagaaaagctctgttcatctgtttgaaaaagcgttacaatcatttcagaaagatagggaggtgttccatggatcagaaaaaaaaacagagtgcatgggtttagatggaatgcagaaaatgaacggtgctattaatgccgatctcatgactgtggaagagattcatcagaagctggaagcaggatataaggatatggaatgcggaagagtgcgggaggcatcggaggcttttacagaatttcgacagaggcatgaagccagataaaggtgaaagggggaagagcatgcaggttgtcatcgagatacccaaagaagtattgtacgatacaaagcaaacgatagaacaagcaacagactttgcaaaaagagcaactgcattgggattttataagcaatatggggtatctgtggaattgtgttctcagattgctggaataacagagaaagaatttatagactatttaaaagaaaatggtgtttccgtatggaaatagaaaaaagatataaaatgctgacagatacataaaaaatgagggatgcacatagaataaaacaggtatgatttgtccttgacaaagaagtttgttgaggatatactgtacctagtgatcgcactacggaaacttgagaagcccgtagtccggaaggctcctgcgggggcctttcgttatttttagggaagtacaaaggcggcagggaaatgaagaaaaaaggatttttaacatatgatgagcagattgcctttttaagagaggaaaagaatctggaaatacaggatgaagaatatgctaaaaagatattgtttaaaacaggatatttcccgttgatcaatggatataaagaggcatataagaatccagtaacgaaccaattccaagatggcattacttttgaagatatttatgaattgtatcaatttgacaatgatttgcgaagtattttcataaagtatattttgatggtggagaggaatatcaagtcttctttatcgtatcatttttgtcttacatatggtgatatgcaggatgattatctggacatgaaccattatgattattcaggcaagaaaaagatagtgattcaaaatatgttgaaaatcatgagaggacagcttagaaacgatagtgactatgtgtacatccgccattatatgaaaaaatataagtatgtaccgttgtgggtgctgtttaatgtgttgactattggacagttatcaaaaatatatagctgccagaaaggtcgggtacagatacaggtttgtcaggattttggaccgattaagatcaatgagatgatcaaaatgttagcagttatgacaaagttcagaaatgtgtgtgctcataatgatcgtctgtttgactttcgtaccaaggatgctttatgtgatatgaaaattcatgaaagactttctctaccaagagagtatggacgatatatgtatggaaaaaatgacttgttcgcgcagatgattatcttgaaacttttattgccggaagatgagtttaaaatgtttttccatgaattaaaagtgtgtttccgaaaacatccagtacataaagaagttcttggaaagatgggatttccaacgaaatgggagaaaatcggaaggataaaaaaatttacgaaaacagaattaaaataataaagaaaatatgaacatcaggcaggatatgttcccgtaaaaaggaaggtatcctgccttttttgcatgaaagagaggaaattcatatgagaaaattttatacagcagaagcagtaacagaaggacacccagacaaagtgtgcgaccagattgcagatgcaatcctggatgtgtgtctgaaaaatgatgcggattccaaggtggcttgtgaagtgcttgccacgaagggaactgtcattgtggcaggagagatcaccagcacctatgaaccggatgtgtttggtgtgatccagaaagtattgtctgaagtgggatattccagcgaaggggttgccatggatacgtttgtccatcagcagagtccggacattgccaatgcggtcagggaatccaaagaaaaaagggaaggggtgtctgacaatcaaatggattggtttcaaggtgccggggatcagggcgtcatgatcggatatgcctgtgatgagacgccgcagcttatgcctatgcctgtggtgcttgcaaataggattgtccgggaactgtctgcctgtagaagaagcagctatattgaagggatctgcccggatgggaaagcacaggtgacggtagagtatgaggatgggaagcctgtccgtctggatagtgtggttgtatcctgtcagcatacggaagataagaatctgaagaaactggaggcagagatccgaaaaaaggtgcttcttccagcacttcgtcttcttccgccggatgaagatacaaagatcctgatcaatccatccggacgttttgtctgcggaggcatggaggcagatacgggactgactgggagaaagttgatggtagacagttatggcagcatggttccccatggaggcggggcattctccggaaaggattgttcaaaagtggaccgttctggggcatatatggcaaggtatattgccaaaaatatggtcgctgccggacttgccagcaagtgtcaggtttcccttgcctacgccataggtgttgcccagcctgttatggttcaggtagatacgtttggcacaggaaaagtgtgtgcggatgactgtctgaaaatggcgatccccttggtgtttggactgacaccaaagcagatcgtagatacgctgcgccttacccgtcctattttccggcagacagcagcctttggacattttggaagaaaggaactgccatgggagcgcaccgataaggcagaacagcttcgcaatgcggtgatctgatggcttgggttacggaagaagagtatcaggtagccaagcaggtgcgggcatatgagtatttgcagacataccaaccgggaaggctgaaaaagacaaggacaagaaacgaatggcagcttcaggaccatgacagttttaagatcaatgagatcaccagtaaatggcattggaaatccagggatatcggtggaatgtctgccctccggtttttgatgcaggtagacggcatgggatatacagaagccgtaaagatcttgtgtgagcagacgcctgtgtatgttcccagagcagaaccagcacctaaaaagaagccctttgccctgcccctgcccaatgacagtttttaccgggtgcggagatatttgaaccaaaggggaatccgggatgaggtactggattactgtgtgcagctcggaatcctgtatgagagcgccccctaccataacgctgtttttgttggcatggacgaacagggacatgcaaggtatgcgttcctgcggggaatctatgacaaccggggaaagagttttcggatggaacaagaaggcagtgaaaagcaatacagcttttgtgttccgccccttgggaaaagctgccgggtggcagtatatgaagcctgtattgacgccctggctcatatgacactggaagggaatgcggataaataccgcctgtctttgggcggtgtcgctgcaccgaaggaagggaccaggcagaacgtcagaaagatgaaagtaccggatgcattggaacattttttgaagcagcatccggaggtgacggagattgaaatctgcaccgatcatgattttgccggacgatgggcatgtgaacagctaaaagaccattatgaaaaagaatatgctgttttctgcaacctgccccaatagagggtgctgattatggagacctggcaaaacaggcgtgggaaaaacagcagaaacagcgaagagaacgtgggaggtgaagcgaatggaagataccataaaaatagaattgttgacaccactgacagggaatttcacatccagagaactggaaaggcagtgggaagagggggaatacgagtacgatgtttatgagggactgccattggaagaagcagacttgtcacagtatgaatcggagatcaaagaagcaatcgaaaaatataatgccattggaaatgaggaaggaaagccctgcaatttaatggattattttgatggcagtacagccatcaaagagaaagtgatcagtgcagtcccttcagtgaaacaaaaagagggtattttgtatggatgtaccactttggaattaactacatttttagaacagccggaaacagaagaactgtatgaatatgttaccgggcagtatagtgacggatggggcgaagggtttgaacagcaggaaatccaagtcggagatggagaaatctatgttcatttttggcagggcgatgactataaaattcagatcagtgatcccgattatcaacagaaggaaacggaaatgagacgtccgaagatgcagcttgtgggacaggatggaaatgtgttttctattctggcaagggcaaataaactgcttcaggcaaatgggcagggacaagaggcaaaagaaatgattgcacgtgtccaaaaatcagagaactattatcaggctcttcatatcatcagtgaatatgtagagacggaattgagtgaagattttcagaaagctaccaagccgccaaagaaacatgggaaggaagaatgccgatgaagttcgcttttgccatatcataaaagatatgggaagaaaaaatagtagaaaccgatgaaaaagataagaaacagcctgcgggctgataagaaaggatgatgcctatggaaaataccctgcaattagggaacttattgaaagaaggaacatacccagaggaatataccggaggggagaagtggacgctcctgcatggagatacgctgaaactggtgaaggcatttcagccgggaatctttgatgcagtgatcaccgatccgccgtatgcgtccgggggaacgaagcagaatgaaagaaaccgtaccaccaatcagaaatacagcagtatgaaggctgaaaatgccttgccggattttgatggagataacaaggatcagcgttcctggacacactggatggcagagtggctttacgatgtgcggaaggcctgcaagatcggagcgcctatctgtctttttattgactggagacaatacccgtccattaccgatgcccttcagtgggcaggctggatctggaggggtacagcggtgtgggataaaggaaactcccgtccgcaaaaagggcgtttccgccagcaggctgaatatattgtgtggggcagtaacggaccgatgcctatcagccgtccggtgtcctgtcttcccggtgtgttccgctatggaaatccccagaaccgtatccatgtgacagagaagcctttgcagcttatgaaagatgtgatccagatctgcgagccaggtggaaggatcttagacccctttgccggagctgggacaaccatccttgcagccgtagaggaaggatatgaggcagtgggcatcgaggtgacggatgcttattataagctgggaagtgaccgggtaaagtttgcactggaagcaaagggaaaagaagaaagcgagaaataacaagggcatccacatggatgtccaaatttatttcagaagaagaaaggtgcatccacatggatgcaggaaaggagtgaggcgatggaacaggcgatggcgtatgtgtgctgtccggcagaagaaagcagggtgaaggtgcagagatactgccggaagatttatgagctggggtatgtaccgatttgtccgaggtttgggtttctgccatttttggatgaaggggaagcggaggatcagcaggcatataaccggatgtcccacttgatcttaaaacggtgccggatggtggtggtctgtggaaaagaagtgaccggaacgatgaatacagatatcagcactgctgaccgactgcatatcatctgcactacattggatggtttgatcaagatcaaagaaaatgaatcgtaatcgattttatgagaaagagtcgatgttaatcgatggaactggttttgcaagcatagcgtttggatatccaaacgcactttggggagaaccccaatcccccggcagtcgagaaaggagagaagtgaaatgttttttgcaggaatggctcttgggatagtggcaggcgcagcctttggcattgggatcatgtgctgtgtagttgccggaaagcaggaggatcagcagatggaacagatacgggtacgcagacagaagaagggagaaccaaaaacaatccatttccgggatcgggaagggacagagaggttctcccttttggatggggaatgtctctgcatgatggcagaggacggaaccaggcagattggtctttgccactttgtggatgggaagcaggtggatgtgaatggccaggtctgggatattggggaacttctccatcagatggaatgcagaagaatccaggtgtgtccgctggaagggagtgatcactgacatggatgagatcgcagaaatggaagagcgcttggaactggctttagagttggaaatcctttttaatcatgcttatgaaagcaatgggggaatcgggtttacggatcatgaattctggaggcagagttcagagattgctgattccctatggaggcgtgactatggctggatcgaacataccctgcgtttcattggcggagaggaagcccttgtgctttccaaacgcctgaaatcctatcagcaggaacgggaagagaaaccgaaaaagcgggagaaaagaaaatatcaacaggaggaaaggtaggtggccggatgagaaaacgaaaccatgtagtgcctgtccgtctgaatgcgaaagaacttcgccatctggatgggcaggtagcaaagagtggactaagcagggaggaatttttacgctccctgatcttaggcgcacagcttcagacaaagccctgtgagcatcacgcagaacttcttcgaaagattgcggggctttgcaataacgccaaccagcttgctcatgtcgccaatggcaccgggatggcaggggaagccagcgtacaggaaatgctccggatttccaaagagacctggcgtctggtgaaagaggaatggtagatggcatataccagcgtcctccccgtccaccgcctggagcgttccatcgactatgtgaaggatcggacgaagaccaccaagagcgccggctctttggaagaagccattgattatgcattaaaccgggaaaaaacagaagagaccatttttgaggatgccatggggtgtacctgtgaaaatacctatgcggacatggtaaagaccaaagagcgcttccataagaaaggcggggtacagggctaccatctggtgcagagttttgcaaaaggggaagtatcacccgaactggcacatctgatcggacaggaactggcagagcagttattgaaagggcagtttgaagtggtgatcaccacccatttgaataccagtcattaccacaatcatctggtatggaattcggtgagcatggtggatgggaagaaataccacagcaatgccaaaagttattttaccgaagtgcgccggatttcggatgacttatgcaggaaatacggtctttctgtgatccagacgaaccaggggaaagccatgcactatgcccagtggaaagcagaagcagaagggaaacctacctggaggactgccatccgcatggatatccgggaggctattggcgtgagcttttcctggagtcagtttgtaaaagaaatggagaagcggggctatgcctggaagctgaaccggaagtatccggcgttaaagacaccggatatggagaggtatgtccgtctgcgttccttgggaaaaggctatggggaggcagagatccgggaaaagatcctgcgtccaaagatccaacaggtgtatagaaaaacacaggtgcagtttccaaagagaaaacttactggacttcaaaagttgtatttttcttatctgtatcggatgggagtgcttcagcagaaaccgaaaaggatttcttatgcggtccgttccgatatccgaaaactggatctccgcatccggcagatggagtttttgcaaaaagaagggatcaccaccagggaagagctggcggcataccggaaacctttggaggaacaggtgctttccttgatgaaggagcgaagaacgctataccgaaaagaaccgggaagtatgcgccttcaggagatcaacggggaattaaaagaacttcggaagaagatccgtttaagccagcagatcgagatccagtcgaaagagatggaagagaggttaaaacgggcaaaggaacaggagcaggtacaggaatcgtccgggaaacaacgaagggaagaagaacggaagcggtaaggaggtgagagcgtatgaactatggcggtgatgcggcagatcagatcgtccggtattccatggaagggatggaacacaccctgcggatcagcgggagcattgcaaagaatctggcagtgctgatcgtagcggtgctgaaggaccagaaaaagaccaggggaaagaccaacctgcttcggatgttaaaggaacagcgggcaatgaaatttttcaccattccccatgacaggctgcgggagtttgccggggaagccaaatccaggggacttttgtatgtggtcatccgggataagaagaacccccggttttccgagatcatggtgtttgccgatgatgcggcaaaggtgaaccgagtgctggataagatgaatctggactttgtaaaatccgaagccggggaagcggttgtggaacaagcgccagtccgggaaacagagcgtgtgatcgatgcagaatttaccgagaaaaccgaagcaaaggaagaacttccggtaaagaccgaaaaggtggtgctgccggaaggaaccattgagtttgaactggatgaagaagagcatctgtttgatgtaggggaagtctctccttcggagggaaattttacccaggcggagaaggcagggaatctgtccggaccttcctcgcacagcagcggttctttttccgggcaggaaactagctggaaaggggaaaaaccatctgtccggcaggaattaaaaaagattgaaacggaacagaaacagcggcagaagcaacagcagagccggagaaaaccgagaaatcagcagagaaagaaacagaagaaagtgaaaggcaggtaaggctatggatttaacgaacatgatccctggtggggcaggggaagaaaaaactccacaacagcagttatcaaaagaagaatatgcagccatgaaaaaacagcagagggaagaggtgtgggcagaggtagatgcccaggcacaggcggtgttccaaaatggggattctttaaagggatttttagattttatggcgcagtgcaatacgcagaaaacacccaatcttctgttgatctacggacagaatccagaggcaacggtggtaaaatcctatgattactggaaaaaagaacaccgttctccaaaatccggggtgcatggttacacctatatggtcagtacggaatatgaaaaagatggggagatgcggacaggctatgccatcggtaaaggatttgacatcagccagatgtccgggaaaccgctggaggaacgtccgcagcgttccatggaagaactgatccatgcagtcttaaaggatcagccagtgcggatgcagatcgcagacaatcttccggagggcatccaggcacagtatattccgaaacagcgtaccgtctatgtgtgcaacggaatggatgagaatacaacattccatgcagtgaaccgggaactggcctgtgccgccctggatcagcatgatgggaactatgcaaggaagaaggtgaatgcccaggcatactgtgccgcgtatgtgatcggcaagcggtatggggcagaggtgtccggcttccagtttggaaaagtggcagagatgcaggcaaacggacagaaagatcctcaggaattaagggggtttttgaatgatgtgcgtcaggcggcctataccatccgcaaccatatggaacgaaattttggggaacaggagcagaccttttccaaggatgcgttttcctttgaggaaccgccaaagcagacaccgaagaaggagaaaaaagagaaacagccggagcgataggttcttaaaaaagttccgccgttgggatagctattgcagggttcttgtggtatgttgggtgtaacaaagacaggagggaatgcggatggcagattactatttaaaaacggataacatcatgaaaaatatgtttacagtggcactcaaagatgagctggcagctcagagccagaggggaaaggtttgtccggctacggaagccatgctgcagagagtccgagcctatgagctttccgagaaaaggcttcccatcaccacagaggaacagagggaacttcgcaatgccctcaaccggctgcgggataagtatctggccatgggcaggtacagcgatggcattgacagcgtgatcttaaaggtcatgaaaccaaacaccagcaggcacttcttctggtagcagaagggagggatgtctatgaggatatatgatcaaaaacaagtggaacaattacgaatgcggtatcccaaaggaacaaggctctgcctggactttatggatgagccggggatgtcgccgggattacaaggaacggtggagtttattgacgatgccggacagatacacatgcactgggaaaacgggagaagccttgccctgatccccggagaggattcttttcataggatagacggaccagcaaacgaagtgccgaagcgtgaaaaagcgaagaaggagcgaagcccgcagaggtagcatggaaacgtgaggacctttgggtatggctgctgtttttgcccgttgtctggtgggcaggcgccatcactgcctgtgccataaaaccggatacgaatctgttacagatcttacaagtgctgaccgaaaaactggatcagcccttttctatttcttatacaccgtacacactgcggtgtgtgttcacattcacaatcgcctatgcgttaggcatcggtatttattactcccagaagagaaattatcgaagagggggggagcatggctctgccaaatggggcgatgctgcttccatctgcaagcgttaccaggacaagcggtacacccagaatcttattttaacccagaacttccgcatgggcttggactgctataagcacaaacgaaacttaaatgttttggtggtgggcggttccggtgcgggaaaaagccgggcatacgccgtagtcaacatcatgcagtgcaactgttccatggtggtcaccgatcctaagggagagcttcttcggaaaaccgggggactgctggagagggaagggtatgaagtccgggtgtttgaccttattaacccggagacttctttttgctacaatccctttgcttatgtacgggatgacaaggatgtgctaaagctcatcaacaacctgatccgtaacaccaccccgaagggggcgcaaagctcggacccgttttgggagaaaagtgagaccgccttgctgcaggcgctcatgctgtaccttctgcatgaagcgccgccggaggaacagaacttctccatgatcatggaaatgttaggttctgcccaggtcaaagaggacgatgaggaataccagtctccgctggatatcctgtttgaacgtttggagatgcgaaatccggaaagcattgcagtcaagcagtatgctatttacaagcaggcggcaggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgatgagttacagggcgagagcaattccatatccaaccaaaagcagatgttagaggattttgccctccggaacgggctgcccaaccctacgcactttaccgatgatggtatctcaggcacccgttttgaccgccccggatttttggcgatgatggaggaagtggaggcagggcgtgtagaggcaatcgtcatcaaggacatgagccggttggggcgcgactatttaaaggtcggtcaggtcatggaggttttgcggcagcgcggagttcggctgattgcgatcaatgacggtgtggacagtctgaaaggcgatgacgatttcactccgttccgcaacattatgaatgaattttacgcccgtgataccagccggaaaatccgctctgtgtttaagtcaaaaggcatgagcggcaagcacctgaccggtactgtgatttacggctacttgtgggatgaaaagcgggagcattggttggtagatgaggaagcttccgaagtggtacgccgtatattctccctcacgctggagggatatgggccttaccagatcgcctgcaaattatccacagaccggattgaaattcctgtcgtacaccttgcccgcttcaacgagggtgtgaaccgttcaaagccggtcaaagacccctatggatggggatcatctaccatcgtgaacattttgaaaaaacgagagtatttggggcacaccatcaatttcaagacccgcaagcactttaaggacaagaaaagccactatgtttctgaggacaaatggacgatctttgagaatacccatgaagccattatcgaccagcagacctttgatttggcgcagaaaatccgcagcaatgtacggcgttatccaaacggctggggcgaagcggctcccctcacaggcttgctctattgtgccgattgcggcggcaagatgtatgtccaccgcaccaacaatggcaagcgggtttctcaatatacctgttccaattataccaaagttccgtgtgggacactatgccctacacaacaccgtatcaatgagagtgctgttctgacattggtttccgacacgctccgggctattgctgaatattccaaaaatgaccggacggaatttattcacactgttcaggagacgcaggttgctcaacagagtgccgatatatcgaaaaagcgcaggcgtctggctgctgcccaaaagagagccggagaactggaaaaactgatttgcaaaatctatgaggacaacgccctcggcaagctgccggatgcacgatatagggcgcttgatgcacagtatgccaaagagcaggacgcacttgagattgaaattgcagagctggaaaaggctgttaccggctatgagcagagccagaaatccgcagagaaatttatagccctaattgataagtatgagaattttgacactctgacaaacaccatgctcaacgagtttgtagagaaaatccttgtccacgaacgcgcccgaaaaggcagccaggacaccacgcaggaaattgaaatctacttcaattttttagggcgctatatcccaccatccttacagccggttcctttaaccccggaggaacaggaagaactgcgaaaaaaagaagaacgcaaggacaggcttcatcagaattatttgaagcggaaagccagcggcgcacagaaacagtatgaggacaaaatcaaggcgaagaaaaaagcggaaatggacgctaagaaagccctgatccgggctgaggatatgaaaaaaggtgttttttctactgtcggacagctaccaaaagtagaaccgcacaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacatctgatagagattgaccggacagcgcaggagcgtgtggacactatgttgcctcacatgatggagactgcgggtgtcacggaagaactgaaagcctgtgaccctatgcgttgggtggggctgatgaacacattaacggcacagattgaggaaattttaatcagggaactgatttgcagctgaatgggaggtgcgggaaatgctgacctttgaaaagattttgaaagtgtttcaggcatatctggatgatgatccactgtatgaggtggttcagaccagccacggttatacattgatggcatgggaaccccaccggaatgactggtacagcgctgaaatacagaaaaccccggaggatttacggaacgctttgttgggtacatacgccaactttctggaagataagattactggaaatgaccgtgacctgactgtgacagaaaccggagaaatccagcagaggtgtcgagaacttttggaaaagtgccgggaaccttgatatagaaatgccagaaggaggccgcgattatgcgtcctccttctgcttcgcagtctgttccattttgagcgccccgtctatggcaccttcgataatcggcaggtattcttcagggcagagtttcagcttgtggctgacccgttgccgctgttcgctttcttcccgcatgatctccgggttaaaataccgttccacgggaagcccgcaggctttaataagctgtatgataaccggcaggctgggaatagccccgtcgttttcgatgttggcaagataacgccagtcgatattgattttctctgccattgctttgcgtgagatacgctttgcttgccgggctgctttcacatccgcaccgaaagtttcaaagccagggcaatcttcaatgttcgccataaagcacctcccacatacattctatatttcatagtctgtccgtgaaatgttgcaatatgcattttagttacagtttatatttcatatctgtttggtttgtagtagaatgtggcaaagggaggctgatgcttttgaacgtaacattttgcggacacagcgacgtatcgcagcggggcaatgtccggcaatggctctatgaaacagtggagggcctgattacacaggaaaccgcagatatgaaatgctggggcgcattgaagctgctttgggggatgaatataaaaagcaatccatgacggagcttgttgcgacaattcaatatggagataacgacggcaacacgatcaactattacattctcaaaaccacttgttacgaggctgaccctgcggaaattacggggctgaacacggaggccattatgctgattgtcggccccggaacggctgacgcctgccaggaaatgaaaattcaggattgggacgctgccctttatgaaagaggggaactatcctacctgtgctggacatattcgccggaggtgagctatatcctggaatatagcccctatgcgtttgcggatgaagaaatcataaaaatggcggaaagtgcaaagcccataaatgaagaatagacagacgccggacacggcggcccgctggccgttgcatccggcgtctttattatggcttgtttctacgcatttagaaccccaatacggcggcaacgggataaagaataccgccgccccagcaaccacgccggaaaagccttgaaatttcagtcgttttcaggctctaaacgcgtaggttggcgggctgttgggacatagcaaagccccggcagcgtggccggggcctgatgatctttacttaattccatgaagattcctgtattccctggggccgaggccataggctttcttaaacaattttgcaaagtggccggaattgtgatacccgactttagccgcaatcgtggcaattccataatcagaattttttagcaaaatcagcgcctggtttaaccgcaattctttgagatattcatacggtgttgtcccataatacttccgaaatgccagttgataccgggctgtactcatacccgctatctgggcaagttcttcccctgtcgggtatgcggccagatcatttttcatcaccgttaccgtttttcttaaattgcggatgtccttataatccagctttacagaaatatgcttttgttcctgctccatgcctttcacaacaagagaaagaagctccattaccttgctttccagatagattttcagcgtatgcccctctgcctgacaatcccgtatctgctggaacacaaagttgagttccggcaggctggggtttttgagaatgtaattccttgcagagttgagaagttcggcgttgttcctgtcatgcagccgaaaataagtattgaagtatttgggcgatagaatcactttcgtaaaacgaacaggtttcccgccctcgcaataggtgtaagttttcttctgtgtgtttagatagcaataaatccccttatccacctgattctttttccgtccaccaatcttgaaagaactgctgtccgtttcaaactggctgatctccatatagtcctctgaaatttcagtgatcttttcaaaggtgtccttgggcgtatagtcaccaatcaaaatcaaaagaagatcgtcctcaaactcgatcagttggaacgtgccggttccgtattcggaaagcatacggtagaaaaaaacaccgtcgccgcaaagctcctgcacccttgcaaagtgcatggcttcggggagctgtaacaaatagtcaattacagatggaaccattgtaccgccgcctcctttctctacttgatagtatatcataccggctttctgcgcgccacttcaaaaaaaggtgacaatccaatatttatcggtcacgattttataaaatatatgaaacaaaaatgctgaaaaccccagaaatatcagcactttcatcgtttttcaaaattcaaacagtaaagcggggcggctattgaaatttccacttcgtgcgggtaaagtagattgtgtcaggttagcaaaatctaactggcacatttcaaagaaaggggtatcgtttcgatggaacaaaaacgaaccggattatcatacgtttttactcttgcgaaagaggaacgcggcaagttaagccttgggatgctgctggcggtcttttcgtcggccctgtctttcgtcccgtatttggtagtctaccaaatcctgcttctgataatcaagcaggaggtgacgcttcccgcaatgcttggttgggccggaatcggcattgccgcagcagtcttacaggcaatcctgacatcctttgccggtatctgctctcatacggcggctttcaacaccatgcacagaatcaagatcagagtattggagcatatgtccaaattcaaccttggattctttcaggaacacgcgcccggacagatcaaaacaaccttgtttgatgatgtggacaggattgaaacctttctggcccacagcactttggaactggcccaggcaatcgtcgttcctctgatgatgttcattttcatgctgcggctgaactggattatggcgcttatcatgctggttcctatgatcttggggattgcaattccgatggccctcatggggcgctacccggatttgacggacgagtttgcaggcgatacggaaaagctgaacgcttccgcaaatgaatttatcaccgctatgccggttatcaaaatgtatcaccttacagccgaaaaatttgagcagtaccgaaattccttgaagatatatacagactgttggattaagatgtgtgaatcgtcctgcaatccgctgtctatcgctcttgtggttttggattctgccattctgttcacgctgccggtgggcggttggctgtatctgcgtgattcgctgtctgcggcatcgtatcttctctttattctgctgactatatgctttttcacgtctttcctgaacatggtgacgattgctatgcagtctatggagctgggcagcggccttgataatgtgaagaagatcatggatatggaaaccatgaaaagcggacagcaaaccctttccaaaaccggctgttatggtattgactttgacaatgtgacctttaactacacacaaggcggaaaggatgcattgtccgacgttgatattcatttggaaccgggcagcttaaatgcttttgtcggcccgtccggtgctggcaagacgacggcggtacagctccttggccgctattgggacgtgagcagcgggacaatcaagattggcggcgtcccggttacagaacttcaaaccgaaaatctttctgacttaaccgcgtttgtattccaggatgtatttcttttggaggacacgcttcttgaaaatatccgtatgggaacagatgctaccgaggaacaggtacgccaggcggcaaaggcggcgcagattgacgatttcattatgagcctgccgaaaggatacgcaacgagaataggcgacgagggagtgaaattatccggcggccagcagcagcggatttcgattgcgcgggccattttgaaagacgcgcctatcgttgttttcgacgaggcaacttcctattcagacattgagaacgaacacaaaatacagcttgcactccaaaacctcctgcgaggaaagaccacgattatgattgcccacaggcttcataccatccgcaatgcggataaaattgttgtctttcaggatggaaaagttgtcgaacagggaacgcatgatgaactgatcgccagcggaagtacatacagccatatgtgggacacctatacaagagaaactatcggggaggagtgaaaagattatgttacgcagtattcagaaattgattggtgacaaacgaaagcagttggtatttcctattttcctgatgtcactggacgccatcggaagccttgtcatgtaccttatgctgtattttaccgtaattcatctcctgaacggttctctgacaggtgggcttgtacgaaactataccattgtatgccttatcagtgtaattctccggctgattatttaccgcagcggctattttctctgcttttccagaggggccgaaatgtgcagcggcctacgcttggatttggcaaaccattaccgttctctaagccttggctattttaatcaaaacagcagcgggtatctgcttagtacactgacaaaggatttaagcaattttgaacttgtattgacccatacgctgccctctatcgtcaaaacattggtcatgggctgcctgatcttggttggaaccttttttatcaactggaaactggcgttggccgagtgcgtggtaattctgatcgcgctgccggttttgaattggggcaaccggcttgtagagaagtacggaacgatcaagcgtgatctgacttctaaaatgatctctattgttctggaatacatcaagggcatgaaagtgttcaagtctgcaaatatgacaagtacgcacttcacaagaatgtctgatacgttggaggacatacggaaaaccagcgtacaggcggaagtaaaaaccgccgcccccacaagtatgtattctatcattgcaaatttccttttgccgtttgtcctgctgattggaagctatctgttccttggcggtacgattgcttctgaactgcttgtggcgtttatgcttatgagccttgcgctttctgcgctgctgattgcgtttgaacattcgtataacctgctgaaagaactgaaacttgccacttctaatctggaacaggcatttgacacaaagccgctatcctacaaagaagaaaaggtaaagctctcgcactttgatattacctttgaaaacgtggacttctcctataaccagcaggccgatgttttacacaatatcagttttcatgccccggagggaagcactacggcgctgatcgggccgtccggctccggcaaatctacggttgctaatctgatcgcccggttttgggatgtgacaaaaggctgcgtccgcattggtgggcaggacatacgggagctaaatcctgacggacttttgcactatatcagtgaggtattccaggaaaatactttgctgtccgatacgatttacaacaatatcaaagctggccgtgaagatgctaccgaacaggaagtgattgcggcggcaaaggcggcccattgtcatgaatttatcgaaagactgcctaatggctatcagacccatcttgccgagggcggcaacaccctgtctggcggtgaaaaacagcggattgctattgcaagggcaatcttaaaggacgcgcctatcctgcttctggatgaatcaacggcttctctggacgctgacaatgaagcaaagatcaatcaggcgttagaccgcctgatgaaagggaaaaccgttttcgtgattgcccaccgtctgaacactattcagaacgcagatcagattattgtgctgaatcagggacggattgaagaaacgggaacgcatgaagaactgttaagaaagaaaggccattactacgaaatggtgcaggaacagcagaaagcaagagaatggattgtgaaaggagcctgaacagatgaaaaaactaagtgaacttagcagcggttccacaggaaaaatcgctgccatcaatggggacacgcattttcaaagccgcgtgacctccatcggccttacgattggctgcccgtttgaagtaatacagaatcccaaaaagcggcctgtcttggtatatgcaagagatacgatggttgcaattaacaaagcggaatccgacaagatcatggtggaggtgacaaagcaatgagtgaaaaaacgattgcccttttgggccagccgaactccggcaaatcaaccttgtttaatggcctgactggttcccgtcagcacgtcgggaactggcccggaaaaacagtggagcgcaaggatggttctttcgttcacaaagataccacctataaaatcattgatcttccgggaacttatagcctgtctgcaaattcggatgaagaagttgttacacggaattacatagccagcgggcaggcagatgttgtttgcatattggctgacgcctcccagctcaaccgcagccttttcatgctggctgattataccgggattcgcgttcccgtggttctcctgctgaatatgatggatgtggcaaaatcgcaggggaagcagattgacaccaatggaatcgctaaatccctgggcatccctgttgtgccgctggttgctgccgataaaaaacagtatggcacatttttccgtatgttagaaagcattgataaaaatgcttcgactttagacgaaaagcgcctggcgcagatttatcagaatacaatcggggccgcgtttgacgagatcaaggcgctgcttcctgcggacggaatcggcatctattcgtccacatggttgactgcaaagctgatagaacaggacaaattggcgcgttctcttgtgaaagaaaccgttggtgcaggcacttataccgcgattgaaaagaagctgtccgatgtaaaggacggaaaccttttgacaggtgattgcaaattccagtggattgacaaacttgtaaatgagaacgtgaccagcaagaagaacaagctgctgcggggccggtttgataaggcggccacaagcaaacgctggggaaagcctattgccattggcatgatcgttttaggtctgatctgctctatggtgattggcttcccgctgatggggcttttcagcgggcttatcagtgcaatttccgtccctctggctaactggctgctggatataggcgcagcgccattccttgtatcgctgctctgcaacgccattttgaccgctgtttctttcgctctgcaaatggcaagctatgtgttcggaatcagccttgtctttggcctgatggaagatgtcggctatatggcgcgaatctcctatgtattcgatgatactatgacaaagctgggattacagggcaaagcaattatgcctttcctcgtcagtttcggatgcaatatcggcggaatcactggaacaagggtcattgattcatggggacagcgtgttatgacgattgccctgtcctgggtagttccctgcgcttctacctggggcgtagttggacttgtcagcggtacgttcttcggaaacggggctgttgtcgtagttctggcgttgtttgccgtggcgtttttgcacatctttatcacttataaggtgtttggccggtctttgaacaaggtagaggggcgcaccggcttaattatggaattgccgccttaccataagcctcattggaaaagcctgtttggttccgttttcagcaaaatgggaaatgtacttagccgcgcactccgtatcattatttgcatttccgtgatcttctggctgctttcttactcggcggacggaaatgtggcgaacagtatcatttacaaggtaggaacctttattgaacctgtgacaaacctgtttggtttaccgtggcaactgtttatcgcttttgtcgcttccgctatgggcaaggaggcttctcttggcgttatggcttccctgtttaacacgggaagtatttgggcggctattgagcagtccgctaccgtagacacggcggcacttagtacaagtatgctgtccgtcatatccagaccggaagctcttgctttcctgttcgcgtttttcttcaatatgccttgcctgatggccttgaccgcaacaacccaggaaacacactctatgaaatggactgtgcgaattgcgctctattatgtccttacagccttgattatggcaacgattgcgtatcacgtcggtcttgtcattttctaaaggaaaggagttattgtgctaattcaattattggagtatttacaaagcgggaaaacatacagcgttcaggagttggctgaacttctgcataaggacgtagggagcatccaagtggaacttgaatatttggagaaccaaggatatatccgaaaagtggcttatcaagccgactgcaatcataattgcaacggctgtcatggctgcgatcagcctaccccggctgcccctgatgtcaatatatgggaagttattaaacgaaccgaataggagaaacaaaatgaaacttcgtgcgtcgggcgaggactatttagaagccgtactgatgctgcaaaagaaaaatggtatggtgcgctctattgaccttgcccggcacatggaggtttcaaaacccagcgtatgttacgcagtagggactttacgggagggcggctttctgacaacagacgaaaaacattatctacacctgaccgaactcggtcagaatgtggctgaaaaaatttacgaacgccattgcttttttacaaagcactttatatccataggcgttgatcctgaaacggcggaggctgatgcctaccgaatcgaacacgatattagtgcagaaacctatgaacaactgaaagaatctatcacgaaagaataattacatagcgcatgaacctgccccgattaaggggaaagaaaaaaaccgttggttggggcaggtgattttgcgcgcctattttaagctattaccctaacggcggttttgagaaatcagagccgccgtttctttgcgtttacacaaaccaatgacgacttgcagggacacggtagccgattggaggttaatttaccgtgtccttctttttatttcgcagtatccatgatctgcaccagttaaaaaaagcatagcccctccatcggagtcgtccggctttgagtatgaaatataccatgtaactaaacagcaaaatatactctattacgctcgtatggctttatgccgtccgggcgcttttttgtctctatggagccggaacatcgggtcagcatggcccgaactttatccccggtgccgttctccgccgccccattcagatttaccaaaaaaatctgaatggaggaaaggcagatggaagttaccatcaattataacggacaagctgtggccgtggaggttacgctggaagtctatgaatttcttgaccgggccgatcataaaacggagaacctgttccatgaacagcggcggcattgggatggccgggagtttgacgagtacatcattaccaccgagggtgtaggggtctacggcgaaacgccggaggaatacctttgccgcatggaaacgctgcatgagctgatggctgttctggacacctgtaccgaggcccagcgccgccggttcctgctctatgcgcttgacgggctgagccttgcagagatcggtgtgctgtgcggctgctccaaagtggctgtttatcaaagtgtggaggcggtcagaaaaaaatttataaatttctttgagaacaggcttaacgaatgacctgttttctggctaccaagtgaaagggatcatttcccttatctcagcgaggggcggacagcggacgagctgcccgcctctccgattttcaggaggtaagcctatgaaaacaatcaatctgcggtggatgtatccccactaccggcatgacgagtttgtggatgttacggacgaggtatgggcagcgatgtatcaggccaagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctatacctgattgcagctctgccggtggctctggctcatgccactccgacacaggcccgccgtgttcacgcctactacattgctggtatcaagcagccggaaatctctcggatagagggcgtccacagcagcaaggttagcgttgccatccgccggggtctgcggaatatgcgccgctgctatgatgacctttttcaaacagagtgaggcgtgcctatgcagaccatcaatctcaaacaatattatccattttgcaaagaggacatttttgtggaggtgtccgatgagatcgtcgaagcgtttcttctggacaagagagccgaggccgccagagatcgcaagatgttccggtataaggcgttttattccctcgattgtaacgatggaatcgaaaatgctgcaatcggctgggcgcagccatcgccggaggactacctgatagaaaaagaagaattagccgaatacgaagaactgatacggcgattgtatgaagccatttcctccctgccgcctatgcaggctcgccgtgttcacgcccgctatatgctgggtatgaaagtgaaagatattgccgcaatggagggtattacgccatcacaggcgggaaaatccatccacgctgcactgcggaggctgcgccggtactttgctcgacagagatggacggtcaatctatgagtattttcaaagaaaagaggtgcctgacatgaacgaaaaaattacagcccacccccaaaaagaagaacgggagaaagtcctgaaggagattcggcagcttgaaaaccgaaagaagattttggagaacaagcagcggaacgaagaacgcagggttcgcacccgccgcctgattgagcgcggagccgttttggaggggattttcccgctggctcccgacctttccggcgcggaggtcaaagcatttctgattgccctgtcccatcttccgggggctgcggaattgactgcaaacctgccaaaatccggggacacgccataagtcccttgtttacaagggcgcacttatacaccgttgccggtgtcgtgcgccctgccgggggctgttgcgctctccgagcgcgatggggcgctacactccccaaaccccttgtgcgccccgcgcagccagacacccgcttcgcgtctgtccggctccacggagcctaaataccccttaccgaaaggaggtgccacccatagatttttgtcatattcccgttagtatcatcaagcgcagcgcaggccgttctgctgttgccgcagctgcttaccgcagcggaaccaagctgacaaatgaatgggatggaatgacccacgactacacccggaaaggcggcattgtccatgcggagatcatgctgcctgcccacgccccgccagagtttgcagaccgttctatcctctggaacagcgtggagcaaatcgagaaagcaagggacagccagcttgcccgcgagatcgaagcagccctgccccgtgaactgtccggcgaacaacagcttgcccttgtgcgcgcctatgtgaaggacaactttgtagacaaaggaatgtgcgccgactttgctatccatgacaagggaaccggcaaccctcatgtccatatcatgctgacgctccggcctctgaaagaaaatgggcagtggggcgcaaagtgccgcaaggcatacgatctggacgagaatggacagcgtatcccggatgggaaaggcggctggaaaaatcatcgtgaggatacaaccgattggaacgataaaggaaatgtggagatttggcgggcagcgtgggcggcctacaccaatcgggcgctggaatctgccggcagaccggaacgcattgaccatcgcagctacaagcggcagggcattgataagattccctctgtccatctggggccagccgccagccaaatggaaaagcgcggcatccgcaccgacaagggcgaagtaaatcggcagatcgccgccgacaacaagctgctcaaggaaatcaaggcccgcattacccgcctttacaactggtctaaggccgaagccgaaaagccggagggccaacagcccagcatgattgacttgtgggaggcccagcagcagctcaagcggcctgacacccgcaccggcaaaatccgagctttgcaggagagcgccgccctgttcagctttttgcaggcaaacggcatccagtccatgcagcagctccatgaaaaaatagcagatatgaacacccgatactatgacctgcggggaaaaatcgtcaaggccgagcgccggatcgccattcttaccgaacgcggggagatgtgggaacagtacaaccagtacaagtccatccacaagcagcttgccaaagtaaagccggaaaaacgggaacagtttgaacagcgccacagtcgggaactgattctgtatgacgcagcggcccggtatctgaaagaactgaaagacagcggcgaggcaatcaccccgaaggcatggcagtgggagatcgaccagctgaccgccggaaagcagacggacacgcttgccatgaaatccatgagggaggatttgaaagcagtggaacggctccgcaaaaccgccgagcagctgtcccgacaggaaagggacaagtctcacgaccgtgggccggagcggtaaaggctaccgcgttttggcgtacccctgtcaagtgcgtcgcgtttcacgacatacctttgcatacagaaaaaccgccgtacaggtttccccatacggcggcagactgtttatttgccgaacaagtcgctgtgtgtgccggtgcgggccagcgtcagcaccagaacatcatcctctatgcgatagacaagcagccagtccgggagaatatgacattcccgatggcctgcccaatcgccggacaggtcatggtcgcggtttttatccggcagcggctcgcccattgccagcaatgctacgacctgctccagcagctcaatcttcaagccacgcttgatggctcgtttgtagtcctttttgaaactggtcgtgtacttgacggtatatttggtttctttcatcttttcaggtcagcaaacaactcgtcaaggtcattgtagccctttacagacgggtcttttgcaatcctttccgcttccagcatggcagcaaccgtttctttgttcggctgttccagccttacttcaaagggaatgccgccttcacgaagcgactggcgcacaaagatgttaaacgccgtagtcaggttcatgccaagttcagtaaacagtgcgtccgcctgtgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttaccggctttatgaaagaaatcatttatgaagaacaataagtctgaacctatccccgtcatggattaccgccagtaccgcagagtgcggaggctggtgcatgagtgctgtaactacatcgacggaaactgtatcgccctggacgatggggaggaatgtgtctgtgtccagtctatttcctactccctgttgtgcaggtggtttcgggcggcggtattgccgcaggataaggaactggaaacggcgctgttccaccggctgaatgcgaagaaatgcgccatatgtggggcgctgtttacccccggttccaaccgggccaaatactgcccggaatgtgccgcacgcatgaagcggatcaacgccgcaaagcgcaagcggaaacaacgggagaaatgtcacgctttaggggctgaaaaacccttgtaaatcaaggattttttcgagggtgtcaaaggcaggctgatagatttatcttccgccccctaaaacggccttaaaatgcgtacagaatcccaagagaaaccccaaggaggaaccctatgtcagacaatcgaaaatattattatctgaaactcaaagaaaactattttgacgatgattccatcgtgctgctggaaagtatgcaggatggtgtgctgtattccaacattctgctcaagctgtatctgaaatcgctgaaacatggtggacggcttcagcttgacgaggacattccttacacggcgcagatgatcgccaccatcacccgccagcagatcggcactgtggagagagccttgcagatctttttgaagctgggccttgtggaagtgctggacagcggcacattctacatgagcaacatcgaacttttaatcggccagtcctctaccgaggctgagcgaaagcgggctgcgaggctccaaaataaggctctttctgcgccccggacaaacggcggacatttgtccgacattcgtccaccagagatagagatagagatagagaaagagatagagataaagagagagatagagaagggacgctccgcccgcgcctatggccgttaccagaatgttttcctgacggacgaggaaatggcagacttgcaggccagctttcccaccgtatggggccagtacatcgaaaagctgtccgagtacatggcctctaccggcaagcggtatcagagccatgcagcgaccatccggcgctgggccggtgaggacgctaaaaaagctggcacaccctcacgcaaccgggattacagcgtaaaggaggatgaaaccgtatgattgagattaccgcagaaatccgggcgctgatcgacaaggcagccgccggtgtggaactggccggggacgagtacatagacccggcagacggtctcattcactgtaagaagtgcggcggccagaggcagaccgttgtgccatgctttgggaaatccggctactttatgccgcgctgcatctgccagtgccagagggaggctgaggagcagcgcaaggctgctgaagaacggcagcgccgcatggagcgtatcaaacgccgaaaggcacagggtttgcaagaccgctatctctatgactacacctttgccaacgacaacggcaaaaacccattgatggacaaggcccgcgcctatgtggagaactggaaggaggcatataaaaacaacaccggcctgctgttgttcggggatgtgggaaccggcaaatcttttttcgccggatgtatcgccaacgccctacttgaccgggatgtgccggtgctgatgacgaactttcccaccatcctgaaccgcctgacggggatgttttccgaggacagggccgactttatcgccagctttgatgagtacgacctgcttatcattgacgatctgggagtagagcgcagtaccgaatatgctatggagcagatgtttttcgtcatcgacagccgctaccgcagccgcaggcccatgattatcacaacaaacatgaaactgtccgagctgaaaaacccgcctgatctggcccacgcccgtatctatgaccgtattttggaacggtgtgcgccgattctttttgacgggaagaatttccgggaagaaaatgccggtgctacccgacaggcagcaaaagacattgtaaacagtaagcaagactgattttttaccgggcggcacagacccgttcggagaaaggagcgccatgaacagagaaccccgtactatgcaggtggcagacgccgctactgcgtccagagcgccggaaaacacgccagcgatggtaaagaaaatcggtaagacaacctacaaggttcatgtccatttcagcaataccagcacagaaaccatgagcgataaaatcaagcgtatgctcaaaaatgaaattcagcagatgtgacagactgataaacgaagccgccttgtgctaaactgatgatggttcgcaccaaaatttttgtcaaggaggacacgaaaatgctttacacagaaaaagagaagcatgaaattgagcgagtaaaggaggtctttgcggaacatctgcggcaaagccctgattttgaactgctctgatcggacaaggtaggctatgtctggctggcgattggcgtaaatccagtctatgtggataccggtatcagaatcgaatctgccgccgatctctgttacaggtgtttggacgatgtagctacggatgttttatatatgacaggcaacgatcatgcactggaagcagccgacccgctggaattggccgaaatcaagcggcgctgggagccatatatcaaccagctgccagactatgcgtatctctgcaaagacctgctgaacggaaaaatgtaatctatcaaacgaggtgtcaggagccatacagtgcttctggcaccttttttgtagatttttgtgaatttgattaaaaagtccttgacaatttgtctctggaaaaaccgcaaagtccatcttgatctccgtaggcgtccgtctggctgcattcaatttaaaacagatcgccaatctgacctgtaccgatgaactggatctttacagcatcggagagaaaaaggtggcgctgttttgctgtatcccggatgcggataccagcctcaattatctggtgggtatgatttatagtaacctctttcaaaccctttattatgtggcggaccggaaataccatggaaaacttcctatcccggtacactgtattatggatgagtggccaaacgtggcactgccggatgattttgacaagcttttggcaactatgaggtcgcgcgcaatttcctgcagcatcatcatccagaatattgcgcagatgaaagccttgttcaaggatagctgggaaagcctcatagggaattgcgatgaatttttatatctgggcggcaatgaaaaagagggacataaatatgtctcggaactattggggaaagaaacactggataccaatacctatgggcagaccaagggaaggagtggaagctattctgtgaatttccagcagtctggaagggaacttttaacccccgatgaagtacgccttttggataaccgcaaggcagtgcttctggtgcgtggggaacgccccattctggatgagaaatatgatctgcataaacatgtgaatgtgaaatatacggaggatggaggggcgccgccttatgattatgcgaaggctcccctgtcccatgaagatgtaaccattgataccaggagactggatgattatgaactgctctcggctgaggagatcctcggcagggagcagtctttttgattggaggaatgccattgaagaaaagaaatgaaatgcaaaagagacaggcagcaaaccatgccactgcaccgaaatttatgggaaaaggacccaaatatccgtttgccttttatgtggcactggttctgtccatgacggtaggaggcatcccggtacttgcagccggagatcccctgtcagtcatcaataacctgtccacctttatcttctccctgatccgggccatcggcttgatcttactgggatttggtgtggtgcaggtaggtttgagcttaaagagccatgatcccagccagagagccaatgggtttctgacgctggcaggcggtgtcatcatcacctttgcaaaagagatcctggacctgatcgttgggtagcgggaagagacagaagcgggcagggaggacatcttcctgccccggcaaaggaggtgagactgtttgagtgataactggatcgtgcagaacttaaactctgcactgaacacctggaatgagaaactggcagaaatctggacgctccttacccaaagcccggaatcctttaagggcgggacgatctggagtgtcatcaccgggatcaacggggctctaactgctattgggtatggacttttggtactgttttttgcagccgggatcgtaaagacctgtggcagctttacagacatgaaaaagccggaacatgccctcaaagcctttatccggtttgcactggcacaaggagccatcatgtatggcatggaattgatgacagccctgttttccattgtacaggggatcgtgtcgaccatcatggcacagtctgggatggcaaacgggggtgtgacagagcttccggcagagatcgtggaaaagatcgaagcggtagggatgctggaatccatccccttgtggatcgtgacgctgctgggaagccttttgatcacagtgctgtcttttatcatgatccttacggtatatggaaggatgttcaagctgtatatgtatactgccattgcgcccatccccatttccacctttgcgggagaaccttctcagtcggtgggaaagaactttatcaagtcctatgcaggggtgtgtctggaaggggcgatcattgcactggcctgtatcattttctccgtttattctgccagtccgccagccattggagatacgtccttaagtgcagtgaccattgtgtggaactatgtaggggaattggtgtttaacctgctggtgctggtgggtgcggtgaaagcatctgaccggatcgtaaaagagatgatgggattgtaggaggaaagaaccatgcgtaaagaaatatatgaaaatcaggaaagcagcgataccctgccttttcattgggaatttggtaaggaagagatcaccctgaaagtgtccagctatgcctatggaaatgggcttgcaattttgatgtacagccaaagtgaaagggagctggaattatttagtgacttgacggtcaatcttccaggcgggtatgggctgaaaccgcaggaggcatttgtaagcggtgattttaccagggataagctggccttcattcaagagaacaggctgggaaaggtgctgccgggacaagcccgttcaggatttgccacctacaccccggtggcatttgacctttcaagacttgcccggtatgaccgggaaggggtggaagaattttgcagacaatggggggtggacattccaaaagaacaggaaaaagtccacggaaaatcgacaggaaaaaagaaaagagaaagagagagatagaagtatatggaagtaaaaatgaataaagagatccgtaactatcaggagtctatgtttatgggactgaacctgcgccagtgtattttctccctgcttgccatcgctgtggcggtagggatttattttggcctgggaaactatgtgggacaggagatgaccgggtggctgtgcatcttaggcgctgccccttttgcagcctgcgggttcttccagtaccatggcatgactgcagagcagtttgcctgggcgtatatcaagtctgaatttttataccccaagcgcctgctgtttcagagtgaggacctgtaccatgcctgcatggaagaaacgctggtcttgggagaaaagtcccagggggatggcgcagcccttatgaaaaaaagagaacagcggacaaggaagaaacggatgaaacagaaaaagaaaacgggaaggagtggtgcgtttgattaaaaccttacaacaggcattgaaaatggacagggagaagttcaaagtcccaaggtctgtccagcaggcgatcccgatccagcggatctggccggatggggtattccagtccgggacaaaattttccaagaccttccggttttccgatatcaactatgccatcgcaagcaaagaggataagacagaaatgttcttggattacagtgaactgttaaatgtcttagattccggtgcggcggcaaagatcactttaaataacagaaggatcaataaagaagagtttgaagcatctcttcttttgccaatgaaagaggatgggctggatgaataccgaaaggaatacaacgaaatgctgttatccaaggtcagcggcaccaacaacagcatctatcaggaacggtatctgacggtcagtgtccataaaaagaacatcgatgaggcaaggacttattttgcacgtgtgggaacggatatcatcacccatctgagcaagctgtcctccattggggaagaactggatgtggaacagaggttacagatcttccgggatttcttccgggcagatgaaccccagtgcgttccctttgatatgaaggcatttgctaaaaaggggagcagcttcaaggactggatctgtccccagtccatggaattttccaaagactgcttcaagatcaatgaacggttcgggcgggttttgtatatgcaggattatgccagttatgtcaaggatgacatgatctcggagctgtgcgatctaagccgggacttgatgctgtccatcgatatccttccggtacccacagacgaagcggtgcgtgagatccagaaccgtctgcttggcgtggagaccaatgtgaccaactggcagagacgccagaatgccaacaataacttttctgccattgtgccttatgatatggaattgcaaaggaaggaaaccaaagagatgctggatgacctgaccaccagggaccagcggatgatgttcggcatcctcaccatggtgcatatggcagacagcaagaaacagttggattcggatacggagagcatcctgtcggtggcaagaaagcatttatgtcagatggcaaccttgaaatggcagcaagtggatggactcaatacggtactgccttatggcatccgcaagatcaatgcccttcgtaccctgaccacagaatccaccgcagtgctgatcccctttcatacccaggagatcatgcagccgggaggtatttattatgggcagaatgcagtgagcaaaaatatgctggtggcagaccggaggaagttattgaatggaaactccttccgattgggtgtcagcggttcaggaaagagtttctcggcaaaagaagagatcgtggaccttgccctgtctacggaagatgacatcctcattttagatccagagtcggaattcggttctttggtggaagcgctgaatggggaagtgatctccatttctgcaacgtcccatacccatctgaacgcactggatatggactctgcctatggcaatgacaagaatccgctgatcgagaagtcggaatttatcctgtccctgtttgaacagttggtgggagctggcaacctgtccgccaaggaaaaatccatcctggaccgctgtaccgcagatgtgtaccgggaatatatccgaagcggctaccaaagcgaagtaccgaccttgaaagatctgtaccgacagctcatgctccagccagaagaggaagccagggggcttgccttgtcttcagagttgttcatcaacggaagcctgaacaccttcgctcagaaaaccaatgtaaatacgaagaaccgtatcattgcctatgatatccgggaactgggagagcagctcatgcccctgggaatgctggtcaccttggacagcatcttcaaccgagtgatccagaactggaagaaaggaaagactacctggatctttgccgatgagttttatctgttgttccgctatcagtatagtgcggactttttctaccggctctacaagagaatccgtaaataccatggatttgtcacaggtttaacgcagaatgtggaggaacttttgaagtcggatacggcaaggctgatgctggcaaacagtgagtttttgatccttttgaaccaggcaaccacagaccgagacgaactggcctcccttttgaacatttccgagaaccagttgtcctatatcaccaatgtaggcgcagggaaaggtctgatccgctgttccggaaatcttgtgccatttgagaacagcttcccgaagaacacgaagctgtaccgcttgatgacaacaaaaccaggggaatgctagtaaaaaagatatttttgtggggtgcggctgaacgttcttcggcagcatccttttgggaaggagggaatgtaaatggaagaaggaaaaacagtaggaatccaggaaacgagaggaccgcttcgggagcaggacagtatccgggcgttactggagcttttggaacaacagggcatggaacaggaaaaaggggatgtgatccgcatggcagatcatatcgattccatggaaatgcagctcggaaccgtcttgaaggaactgggagaggtgaagaagcaactgggcgtgatgcaggaaaacaaggtcaaactctttgcggtgaacacgatccagaaagcagaacatcaggtgcaaacacttcgctttcaggtgggagaatggaaacgaaagtttgtggaacgggcagaacaggcagtgtttgattttaaagaaaagggaaaagatgcccttgcctctgcggtaaagggcatgcaccttacccaaggcttgcaaaagctgcagtcttccttacatacggtcatgctgtcgatggatcagaagattaaccgtctggggagtatggcggaggaactgcacgctgccaaagggcatctgaaaaacgcatttttggaaatgaacggaaaagataccgcaaagatcacagagcgaaatccggaacaggggatcatctttcaaacccagaaggtgttattccaatccatgcggagcatccataagctggaacaaaaaacggagcgattgcagcagcagatcgggaagctggaagaaagacaagcaaaacaggcatctttaaaagataccttgcaggagcttcggcaggaaacagcaccccgtcagcttggaaaagaagaaaaacagaaggcagcgatccgataaaggggagttttccaaagggaggtgaaagccatgaaagaagaaacaaccattacctttcttgcttctgagtgcggggagttccatggaatgggagaatgtatcgaatgcacatctttaaaagaggcgttccggcattaccagagattttgcaagcgttcccctcagatggttccatctttggagttttccctgcaccatgcagatgatcctctttataacgaaggagagtatccattagcaacaggggagaggggaaaagagttcttgtcctatgttccctattatgccaatcatccgctggtgcaggaagcggtaagggaactggaaaagctggaagaacagcagaagagacaaaagaaacagagcagggaacggtaagaagatacagggaggtgtgtgtttgaaagacatcaaagagaaggtacgggatcagaacccgaagatccgcaatcctgcctcccggcttcccaaagaactggtgcgttctgccatgctggaaacgaaagagaaatcccggatagcggcagacaaggtgggaagagaaaccggagaggagtctccggtggaatatgccggaaaccggatagaacgggtggaacagcgggctggaaaggaaagcgcttcggctgcttatcgtggcggaaagaagctggcagtgaaaacttatgagaagataaaagagcagagacaaagagaagccgttacagccccgttggacagcgaagcaggaagcggtggaacatctgcccagacaggacagacaagggcaaagaaagggcgcacaggagccggaaggagcatcaagatcaaaccggaagcagagaaaacgatcaaggaggccggaaaccggatagtaaaaacagcgccacgtatagcgaaaacttccccggtttcttcccaaaaggtgaaaacccaagcactcttacaaaaaaagcaggctttccaatccatgagggcagccagggaagcgaaacgggctgccatgcgatctgtccagacagccaagcaaagtgccaagactgcaaaaacaactgccaggggattgaaagccatggcagaagctgccgcccatgcggtgaaggcggcttttgcagcgttgatggcaggaggcggtacggtatttgtgatcttgatcctcattgtggggatcattggcggtgctgcgtttatcgggagttcccagagcagcgagccgctgagtgcggaagtcctggcccatactccggcgatccagcggtatgccagtgaatttggaatcccggaatatgtgcctgtcattcaagccatcatgatgcaggaaagcggaggcaggggaacggatcccatgcaggccagcgagtgtccgtataatacccagtatcccaatacgcccggtgcgattcaggatgcagactattctatcaaggtgggggtacagtattatgcagattgtgtccgggaagccggatgcgaaagtccacaggatatggacaagctaaaacttagtttacagggctataattatgggaatgggtacatctcatgggcaatccggaaccatggcggttatagtgaagccaatgcgctgcagttttcccaggaacaggcagccgcccatggttggccaaggtatggcgatccggagtatgtcccccatgtgcttcggtattattctggcgggggattgtttgccggactttttggaaatgggcagctcgtaaccattgcgaaaagccagttggggaacgaaggcggccagaagttctggtcgtggtatggatttgacagcagggaggaatggtgtgcctgttttgtgtcctggtgtgcagaccaggcaggactcattcaaagcggcgctgtacccaagttctccctttgtacagatggaaagaattggtttcagaaccaaggaagatggcagggggctggaagtatgccaagtcccggtgcgatcattttttttgattgggatcacgatggaacgtgcgaccatgtaggaatcgtggaacgctgtgacggaacaaccgtctataccatagaaggaaactcaggggatgcggtaagagagagaaactatgcgatcaattccgattccattatgggatatggaatggtagtttattagaaacaggaaaatgaatgatagatggaattgtagagtttgaataacaatgctataataggaaatgtgggcagggcagatgtcctgcctgctataaatttgaaaagtacaatcatcagattgagaacatagagtcattggggagtgaaatatttgaaacgggaagaaatctttgaatatgtaagaaagcaatatggaacagttccggagtatctctgggaaacatcaccggagagtgcagtgcttcggcataagaatggaaaatggtatgcagtattgatgcaggttgaaaaatctaggttgggattagaagaagagggtatcgtggatgtgatcaatgtgaagtgcgaaccggatatggtaggacttctgacacaaacgtatggctttcttccgggatatcatatgaataagaagtattggatcacgatgctgctggatggaagcgtaagtgaggcgaaaatcttagactttctggatctgagctatgacttgatagatggaaagaactagagaaaatttataagggaagatagagacagatattgagaaacccatgctgctgcttttcataacagtatcatgggtttctttatcaaggggacatcgaattgtggacaagggaaaaacagcaaggtaaaataaaacagaaaaaattttatttcgtgaggtttctgtgacatttgggtgatactctaaaaagaaaaggatgtgataccatgcatattttagtagtcgaagatgaccacttattaaataatacgttatgctacaacttaaatgccgccggttacaaggtggattccgcgctctgtaaaaaggaggcggaacattatattgagaaacagaaatatgaattgattgtactggatgtgaacctgccggacgggaatggatttgatttctgcaaggaggcaaaggagcgctgtccggagactgcggtgatttttctgaccgcaaatgatatggaaagcgatatgttaaaaggctatgaactgggagccgatgattatgtaacgaaaccatttcccatgagtgtgtttcagaagaagctggcggcattactaagccgcattgcaaagcagtcggaagaagatcaatataaggacggaacactgtttattgattttaaagaaatgaccgcttcactggcggggaacgcgttggtgtttacccctctggaataccgtctgctaaaaatctttacgaagaatccacaaaatgtattaacccggcaaatgttattggaaaggctgtgggatattgatgagcactttgtggatgaacatgcactgacggtagcggtcagcagggtgagaagcaagattgagaccaacggacagcagtatatcaaaaccgtttatggtatgggatatatgtgggtgggaggtgtgcagaagtgagacaaaaaacgtatctttccatcaatcatatctgcctctttttaggactggtgttcgggatgacagccattgggagcagcatattggtactatggatcacccgaaatgtaacggctgccttgtgcgtgctgggttttggcgtgtttgcctttggatgcggcgtgttctttgtatggaatatccggaaaaaactggtcttgttttcggaccagctttgcgaactgttggacgggatgatgtccgggaaagaggaactgccggaagagagacagcaggaggaagggctgttttataaaattcattatcgtctgaagcgattatatgaagtcatgcaggagaaccggaatcatatcgcgaaagaacgggaagatttgcaggaattgatttccgatatttcccatcaggtcaagacacctattgcaaacctgaaaatgatcaacaatacgctgttggagcaagaagttccggcacagaaacaacaggaatttttgacagcgcagagcagccagttggataagttagattttctgatgcaggcgatgatcaaaacgtcccgattggaaacaggcgtgatttctttggaacaaaaagaacagtcgatttatgaaacactggcggcagcgctgggcgggattttcttaaatgcggagaaaaagaagattgatgtgcaggtagactgcccggaaggattgctggtttcccatgaccggaagtggactacggaagccttgtttaacattttggataatgcagtgaagtacacaccggcgggtggaaacatctgggtatcggtggaatgttgggaaatgtatgtaaagattgacattacagataatggaatcggaatttccgaagaacatcagggaacgatcttcaaacgattttatcgggaggatacggtacatgatgcagaaggaattgggatcggactgtatcttgctcgtgagattatctcacttcagggagggtacattgtggtgtcctccgagccgggaaaaggctctacattttccgtgcgtctcctgagaaaataggaaaatcaccggaagtgccaaaaagcacattccgggattgtaagcagtcgtcaaggtctcgggcaagcccggactttggctcgttgcctatacaaaaagttgaaatgtcacaggattgtgacatttcagccccaaaaacaccgaaaattctttgttttcgtgacatttctgtgaggtttggttgttatgataggggtaacaaaaagaaaggacggtgttcatatgaatatcttagaaacgactgaactgaaaaaatattatggggcagagccgaatattacaaaagcattggatggagtgaatctttccgtagaaaaaggagagtttgtagccattgttggaacttccggcagtggtaagtctacgttattaaatatgatcggtggtctggacgttccgacttccgggaaagtctttgtggatgggacggagttatcaaaactcaatgaggaacagttgaccattttccgtagaagaaaaatcggatttgttttccagaactacaatctggttccggttttgaacgtgtatgagaatattgcccttccggtagaactggacggaggaaaggtagacaaaaattttttagaggaagtcgtgggatttttaggactgaaagagaagttaaacagtatgccgaataatttatccggtggtcagcagcagagagtcgccattgcccgtgcgctcattgcccgtcccaccattgtgctggcggatgagcccaccggaaacctggacagcaagaccagcatggacgtgttaggtctgatgaaaacaagcagctacaaatttaaacagacccttgtaatgattactcataatgacgagattgctcagcttgctgatcggattatccatatcgaagacggaaagatcgtacagtaagggggcgggactatgagtgatgttctatttggaaacaacaataaagcagtaatcaaaaaggtggcaaaccgcagcttccacagcaataaaaaacggaatatccttgcagtcatcgccatagccctgactacgtttcttatgaccgcagtgctgaccattgggttcggtgcaaaaaatacgatgcagtatagtcaggcgagattattaggtagtcaggcggatgctttggtgcagggaatgacaaaagaacaggcagagcagttaaaagaaaacgctatgtttgaaaaagcaggaatccagattggaattgcatttttagaaaatacaaagcagcttaatgtggaactggactatgcagatgagacattgatggaagtctgttttatgacaccgagtatcggaaccataccaaaggctgagaatgaggtactggtatctgcaaatgtgctggaagatctggggattccgaaaaaggcaggggagacgattcccgttgatttaaaagtagatggagaaatcgaacattttgatatgaaagtatccggtatctatgaaccggtaaaaaatgatgtgggatatgttatggtgtcccaggcatttttagaagaacaggaagaaatggtttcagctcttcggaaagacagagaaaatagaaactattataatgcccatgtgattttgaaagatcccagtatggtggaagaacggattggagagttcatccgtagtatcggaggaaatccggatgatcgagaagcagaaaactatgtaaggattgcaccgacaccatctgctacacagagtgatggaaatttagtggtatggctggcagcaggcgtatttggaattctgtttatgttctgtggttatcttctgatttacaacgtatttgatatgggtgtgacaaatgatgtgagacaatacggactgctccgaacgataggaatgacaccgaagcaggtgaaaggtttagtgcgaaaacaggcaatgtacttgttcctgattggtacaccgatcggagtgcttttgggaatcttacttggaaaaggaatgcttccggcagtacttcagatgtttgtcgcagaactgggagaaaagaatgtggtggtcggttctcttccctatctgccaattattattggttccgtgctattttctgcgctgaccgtatggatcagtacaaggaaatcagcaaagaaggcatcccgtgtctctccgattgaggctgtccggtatgtagaacagagcataggaaagatcaaggaacgcaagcacgtgaaaggggcgttacttccgcgtatggcgaaagccaacgtgcagagaaataagggacggatggtattggtcattgtttctttgatgctgagtattattctgttaaattctgtgtttatctttgcaggaagttttgatgaagaggtatatgtggaacgccagatgcgaagtgattttgcagtctatacagcagaggcaggactgatgcagaaagggtttaccggacatagtgctgcattgccagataatgtggcagaagcagttacacagcgtccaggtgttaaaaatgtgacgaaaatgtatcggaatacctttgaggacagtcaggtttcttgtgattggggaatcaattatgaagtggacgaagaagtgacagaaatgacaggatttccggataatatcaaagaaggaaaaaataaaaaaggagagtttatagttgaaagtcatgcggcattgacaccagatggaagaccccttgggaatgtatatggcgtttccgattccctgattgataagctagatattcgagaaggggaaaaagataaatcagttttaaaagaaaagcttcaaaatgaaaatggaattattttaattgccggatataacgacaagggagaatttactgaatattcagaggcagattatgtaaaacagcaggtaggagatcaaattcagttttatgaaaatggcgttccgacagaaacatttacggtacttgcaaaggcggctacaacagatatggaaactggaagtttgttcggaccgggaagtaatatacaagcggagattggtggacctgtcatgtatatgtctgaggaacacttcaaagagctatacgaaaagccatcccttttctgcgttctgtttgatacggaaaaagagcaacaacaggagatggaagattatttatcagagtacacaacccagaaaaatatggatattctctatcagtcaacagagaaattgggagcgaatatagacatttataagaatgcatttcttttaatcggctgtctgatcggaggaatctttgcattggttggtatcatcaatctgatgaatctgattatgacgagcattgtgacaagacgacatgagtttgcttctatgcagagtattggaatgacaacaaagcagcttcgtagaatggtgatgacagaaagtctttcctatgtgctgcgggcaggtgcgattggaactgtggttgcaataattctgggagtaacagcagtgaaacttttagtagaaaatggtccgatttggtatatgactttccatctgaccatccttccggcaattttgttatccgttatttatatcgtgctggcacttatcattccgatggtttctcttcgtttgctgaatcgacagagtattgtggaacgtttgagaaccggagaataacctacagcagcgatataacaaatgagcaatacaaaaagggaggtctttcgatatggcaatacttgagacaaaagatttaagaaagatatatggcagtggagaaaacgaagtgcgtgcactggatggggtatcgatttccgtagaagagggcgaatttgttgcagtagtcggtacatcgggcagcggcaaatctacactgctcaacatgattggcggtttagaccgccctacttcgggaagtgttacaatccggggaaaagaacttctgaacatgaaagatgaggaactgacgattttcagacgaaggaatatcggttttgtctttcagaactataacctgcttcccgtcctcaatgtgtatgagaatattgtatatcccattgagattgacggtggcaggacagacacagactttgtgaaagagattatccatgaacttgggttgcagaagaaactgaggaatatgccaaataacctgtcaggcggtcagcagcagagagttgcgatcgcccgggctctggcaacaaagcctgcgattattttggctgacgaacctacaggcaacctagactctaaaacgagtatggacgtgattctgctgatgcagtcactcagtcatgagtttgaccagacgattctgatgattactcataatgaagagattgcgagaatggcagaccgtatcattcgcattgaagacggcaaagtcgtttcgggaggtgtgaggtatgcacgctaaccggaatgaaaaagcagtaaagcgtgtggaaagaggaatgatgaaagcaaaccgcattcggaacttgtttgcggtatttgccatcatcctcaccacatttatgattaccaccgtattcagcttgggtattaactatggggagaacatgaagttaatgcaggtccgcaccgcagggacaaccgcagatgtgtcccttgcgatgccgacgaaagcgcagaaacagcagattcgggacttggaatacgtcaaaacggtggggacacagtacatggtcggctctgttgcagagaagaatgacgagggacgggaactttccatcgcgcttcaatattacgacaagacggaatgggaagaacattatcaagaagcaatcaaagatttggaagggaaatatccttccgaggaaaatgaaatcatgctgtcagaggatgccctttcacagttaggaattacagaaccgaagttgaatatggaagttcctctgtcctactacgacaaaaacggggagcaggagagaacattcaccttgagtggatggtttcattcctacacaggcacaggaatgggatttgtttccgaggcgtactgcaaaaatgcaggctatacaatggcagaggatggtgtcctttctttatcgctgaagaaaatgccagatgattttatgcgcattcaaagagatgtaaagttaaatgaaaatcaatcttttagcggtgcggtttccatgaaatcatcaagcggttctgttattgcaatggtcattctattggtattctttatcattggcagcggctacctgcttatttataatgtcctgtatatctctatttcaaaggatacccgtttttatggcttgatgaaaacgatggggacaacgcaggcgcagatcaaatcgttggtgaaaagtcaggcagtgaagtttgcctgcatcgggattcctattggtattttgttagcgactgttgtttcctttggaattgttccctttgttttgaatcaaggatttgaggaaggaaagtcgatgatggatgcagaggtgttttttcacccgatgatctatattctgtccatcctcttttcagcaataacagtttggattgcctgcaatgcaccggcaaaagcggctgcgaaaatttcaccagtagaggcgctgaagtttcagaactttgcaccaaagaaaatgaaaagcagaaattccaccaatggtggcaagttgcatgtaatggcatttcataatgtcttccgggataagaaacgtgcaatccttgtatttatgtctctgtttatggggatcaccatgattttaggcaccaacggagtcataaaaagtatgactgccgaaaactttattaaagaatatatggactattcctttgaatacaacgatattcagtttgagcagtatgaacagctcaataaagaagtaccgcagtttgacgaacactttgtggaacagattcaacaaattgatggcattgaaaaggtagatgttcaaaaaacagtatgggcaggtattggctttgatgaaaccactttagaaggctttatgaaaatcaaatatgaggacagcaaatataaagcaaagggacagtcttatgaacagacgatagagacgctgaaagggtatgctgatgccggtgactacggctgctatattacaacgcttccagacgatagggcactggaagaatacaatgcagaacatcctgatacacctattgacattgaagcgttcaagcgtggtgaaacagcgattgcaggaaaagatacagaattttttgctcctaatacagctttagtgggtgaaacattgacactaactgccgacagtacagacggcaaggcaaccgatttcaaaattggcggagctttttactatgacgattatgataatactctttcagaaggtattggcaggcgcaaagaaataaatatggtgccagatgttatctttgtcagcgaagcgggtatggaacgcctgacaaaagagccaatcatttcggctatcggcgttgacattaaggatttcaacgatttagagcgaatggatagagaattacaggaaatcaacagtaccttaactacatcggagtggcagatgaaatcagctgttaatcagaaagaactatttgaacagacgaactattctttgagtttgctgggaaatggtgcggcagtattgctcattgtcatcggcttggttaatttcgttaatgtgatgctgaccggtgtggtggcaagaaaaaatgaatttgccattatggaaagtatcggtaccacgaaaaaacagattgtgaagatcctgaccttagaaggcggcatttacgctctgatttctacgctgctgattatgacctttggtaatgcgtttctgctgctggtggcggatgctgttccccatctggcaaactatgcggtatttgaatacccggttgctcttgtgatcggcttgattgcagcaatctttgtaatctgtctgagtgttccggcgattgtctataaggcaatttcagatgaaacggtgattgaacgactgcgtaattttgagaattaaaggagttgaaagaacaggagggatcacttgaatgatatattatttggcaacaacaatacagaagtaatcaagcggttatccaagcggtattttaagagaaacagaatccggaatcttgcggcgatactggcgattatgttgaccgcgtttctgtttacttccattacttcgttagtatttagcatgtcctcctccattcagctttccatgcagatgcagaaaggaagtaaggcggacggggacatccggtatctgacggaagaacaatatgaagagttacaaaatagtgattttatcaaggaggcaggatgcaggcggtttgttggctttgcatccaacgcttccgggcatatggttgagataaactatgcagatccggtacagcaggaactgaccttctgtacgccgacacatggaaaggctccaaagaaagtaaatgagattgctacaacagatcaggcgctggaggcgttgggagtagaggcaaaggtgggggaaaccgttccggtggaatttaccttacgtggagaaacctatcagtatgaaatggttgtttccggctggtgggaagctgccaatgataccggaagcctgctgattgtttccgagcagtttgtgaaagacaatccggaaatatttgtaaatacttatgcagaggaccgggagattgcaggaacgtatatggcagatgtggtactgaaggataagcgacacatacagaagcagttacaggaatttgcactttccgtgggcggagaaccggaacagatgaatgcagacaattatattgcctgttcacaaaatcaggtaggaaatgccatgcttcagccgggcatgatgctgtcagtggttgtatttgtactgttgtttgtcgtgagcgggtatctgctgatttataatattttcgatatttccgtgatgcaggacgtaagacaatacggtctgctccgaaccatcggaacgtccacaaggcagatcaaaaagattgtgaaccggcaggcactttggctgacgttgatcggtcttccgctgggattactctttggatttctggtaagcaggatgcttcttccggttgtgatgaagttttttcaggcaaatgctttgaatgccatgaaagtgtccgtgtctccgcttatctttctgattgcggcagtatttacgatttttaccgtaatgatcagtacacggaaaccggcaagaaaggcggcgcggatatcccctctggaagctatccgttataccgggcaggaaaagaagaaaatgaaagagacaaaacggacacatggaacaaagctgtcctatatggcattttccaatcttggcaggaacaaacggagatccgtttttattgtcctatccatgctgttgtgcattgttttatttaattcgattattgtgatcacacagagtatggatgaagaaaaatggatttcccgttctacgaaaacagactttaccgtttacaattccgtggcagtcaatggagtttctccatttcagtatcgagaagacggactcccggtttcggtagtagatctgatcgatcagcaaaaaggtgtggaagaggaaagaattctgtaccggaatacacgagatgatagtgatgtgacgatagattataagtttgaagatctggtttgcatcgcggaggaggcagaagaagattctgtcagcaaagcgtatgaaaacggattgtctctgcgggtagttccgggaacagaagatggctattttggaaatgtgtttggcgtttcggaagcattctgggaggatgtcacgatttatgaaggtgagaacaatccggatgttttgaaagagaaaatggaaaccggagattatgtgattgtcggaacgatcatagaccgactgaccggagaggcggaagaagagacgcagctgcagcaacagcttcaagtaggagattccattacgttttccaaagatggaaaagaagaaaagacttgtacgattttagcaaaagcaacggttgtagcaacggaatacgaaacctatgcgggtgcaaatggagcagcctacattggcggcgatgcgccatttctttatatgagtgacacaaagttcaaggaactttatgaagagccgacgattttcagttacagctttaatgcagaagaaggggaaaaagagaatctggaaggatttttagcggactttacgggagaaaatacttctgttgcctatacatccatcaagctgttacaggagcagcttgcgtccaatcggaacattgttctgctggtaggcggtatgatcggagtgattctggcatttgccggattgattaactttaccaatatgatggtcaccaatatcattacccgccgccatgaatttgcagccatgcagagtatcggcatgacaaaccgccagcttcgcagactgattgtggatgagggcttatattatgcggcaggtgcagatgtaatcggcggtctgcttgcagcaattttaggaatgacagtattaaagaacgtactcaattccccatctatgtggtattttaccctgcggtttacactggttccggcattttttatcgcagtgatctatttgatcttggcggcggtaattccagtggttgtcttacatttctttaataaaggaagtgtggtagaacggttgcggacagcgcagtagacaagagaaaaaacggaagacggggatgatgcaattttcaaatttgaaagaatacggattgatttaaaaagcagacaggtacacattgatacaaagttgattgttttgcgaagaaaagaatttgatattttatcatttctggcagaacatccgggctgggtgtacacaaaggagcagatctatgtgtcgatttggagagatgagcacccggtcaatgtggataatgcagtgacctgtcagataaaacagcttcggaagaagctgggaaataatcccaaaggaacaccctatatcgagacggtttggggtgtgggatataaattcaatcatggaatgtaagagggaagcggtactgagaatagggcagtaccgctttcggtgtcataaattagttgttttgagcttcagacaatcttaactgtttgtggagagaaagcgccataaacaggctgatgagaaaagaaaggacatcagcgattggctgtgcgtataaaattccatttaatccccagatggagggaagaatgaggataacagggataaagcagattccttgtctgcatgcgccgagtaagaaaccttcttttcctttccctaatgcaagaaaaagggaagaatataccgtgtaatagccaaaaagcataaaagtaataccgttgatgcgtaaggaattagctccgatgtggatcatttctgcatttccggttgtaaattgtgaaacgatttgtgttggaaagaggaaaaatccaaagcctacaacgacacaaaaaatcgttgaccaaaggatcgaggttttgattgcctgacgcagtcgttcatattttttcgcaccatagctatatcctgcaatgggctggaatcctttaataaagccgaatacagtcagactacccatagaaacaagccgggtaacaacacccattccggcgatagctgcatctccataagtaccggaagcattgttgatcagagaaatggaaaggcttgttaatagttgaaatacaagggtaggtactccaattttgaatatttctgaaaaaatctctttggaaaaggaacaatcttttaggtggaaacgaaaaatactttttttactgaaaaggtagtataggtaaacgagtgtagatactacttgtgaaatcgcagttgcaatggctgcacctgcaacacccaaatcaaaagtatagataaaaatcggatctaaagcgatgttcaaaattgctccggtcagcagggcaagcattgtagtcttagcggctccctcacttgtgacaatgttgttcatggtaacattaaatacattgaaaatacaagaaataatataaattcccgcataagtcattgcataagggagaatgcttttcgtcgcaccaagaagaagtaagatcggtttcaagaatacaacgcagaaaaaaatgagaatgatacctgcagataaactgcaatagagcgaagtgcttgcaactttattcgcctgttcctctttcccttgccctaataatcttgaaatataggatgctgctccatttccaaataataatcccaaaccgacaactacttgtccaagagggtaaacgatagaaattgcacccatttgactttcccctaatccgcccacaaagtatgcgtctacaaggttatataaagcattgatcagcattccgatcatggttgggattcccatagccaagagtgctttggaaataggcgcatttccaagtaattccaatttttgtttttgattgttcatcgtgtgtaactcctttcacttgacatataatataaaatatattactataaaatatagtaattgaaatgcaaaaatatactactataatttacagtagttgtcaagacggaaggaggaaaaagaaatggcgaccattgacttaattgtgttaggaatgttaaaaaaagaggaactaagtgcatatgatattcaaaaactggtggaataccggaatatctcaaaatgggtaaagatcagcacaccctctatttataaaaaagtgcttcagttagaacagaaaggtttgatttccagccgaacggaaaaagaaggaaatatgccggaaaaagcagtatattctttgacagaaaacggagagatagagtttgaaaaactgatgcatgaactttctaaaaagccaatccatatgtttttagatttcaatgcagtcatcgtaaatttagaaagcatgcccaaagaagcgcagagggaatgtctggatgagatagaaatgaatatagagattcttttgaactatttggaagaaaatcagaaattgaaagaaaaagcagaggatgttccggcaacaggtatggcggtacttcgtcagcagattacattggcacaggcgattaagacatggattgctgatttgaaaaaaacgttgttttagtggcagatggtgtattttttgactagaaattttaattgattgacaagaattttttattctgttagattatgaatatgtaagatcttacagacgaaaaatcataaaagtaggtgtaagaatgtatcatggaagatttaaaaatacacattatcaagctggttttcactggggagaaatgttaagaaaacatggaaattttattcataagcaacatacatttcagattacagaagaacggaaaaagtttgcaatgcaatgtctgccagtctatgagaaatattatccggaagctttggaagagatcaaaggaattgcagatggacaacaaagttcttatgaagatttgtgtacgtttttgttgagcatgtattgttttgagttcagtaatcattgtacgtgctttgctttcagggatcaggaacatattgtttttgggagaaacagtgactttttaatggaactagaaaagttatatatgaactgcttgtatcagttagatagtggatattcatttcaaggaaatacaacagcttttgttcagatggaggatggagtcaatgaatatggtttagcagttggtttgacatttgtatatcccaaagttcgtaaagccggtttcaatgcagggctactggttcggtatcttttggaaaagtgtagaacaacggaggaagcggttgcgtttctacacgaagttcccattgcttcgcagcagattataacaatagcagatgcattggggaatatggcagtcgttgaatgtaatccatatgttacagaagtgattttacctaagaagggggaagaatttgttgtaacggcgaatgattataattcggaaaagatgactccttataagaattgcgaagaaatagatgattggaattctgctgaaagatacaaagtggcatatcaggctttgaaaatgcaggaaaatcagttcagtttaaaatgtgcaaaagatattttatccgggaaatatggctttatgtgtcaatatgatcgaaaaactggggctgatacggtttggtctgtcatttatgatattaaggggcaaaaaatctatcgtgtagagggaaatccgtcacgcaaaggatttaaagaggataagagatttaagtttaggaattgataagtatcttaaattttttaaaagagggtgatacaatttttattttcggatcgttggtaattgatttaaaatgcaggaaggttcaaatcgcttcccggcagatagtgttgagaaggaaagaatttgatattctcgctcttcttgcagaacatccgggatgggtatatacgaaagaacagatttatcaatcaatctggtgtgaggaagtaccggttgatgtagataatgcagtgacctgtcagatgaaacaattacggaagaaattgggagagaatcccaaaggcacaccttatatcgagacagtctggggtgtgggatataaattcagtcatgggatgtaaggagaaagcggtactgagaattgggcagtaccgctccttttcctaatgccaggaaaagaaaagaggataccgtgtaatagccaaagagcataaaagtaatatcgttgattcataaggaactggttccgacttccttgtgcttcccaacttgtattatgtgagagtacgaattataatatagcaatacggaggtgcaatatgaattatataactttgaaagaagcaagtgaaatatggggcatgactcctcgatggataaattactattgctctgcatggaatattccaggcgcagaaaaaatgaggatggtttggctcatcccaaagaatgcgaaaaaaccattagatgactgaagaaaatctagtaggaaactagaaggagaacatcatgattgaagtttattatacggaagatgatgaaatcattggaaaatccgtaaaggaatatttagaacagcacaattgtaaggtgaccctttgtgagtcgattgccgataccagaaaagcgttgctcaaccatttgcctgccgtcgttttattggactggaatatgccagatggtcatggaagcgaattgtgctgctggattcgggaaagatggaaagctctccctattatctatttaacagttcgtggggactcacatgatattgttatgggattccagaacggagcagatgattatgtggtaaaaccatttgaccttgctgttttatattctcgtattttggcattgctgcggagaacagaaaacatagcagacacaaagttgttttgtgatgacttgatgttggataaagagaaaacggctgtctatgatcaacagaaagaaatcatcgtaagtcagccagaatatcgtattcttctggcactgatggaaaataaagggaaaaccatcactagaagtcagttattagagcaggtctgggatcacagcggaaactatgtaaatgacaatactttgactgtcgctatgaaacgacttagggaaaagttgggcaatcccgcttgtttgaagacaatccgaagtttcggttatcgcatggaggacacaaaatgaggggaaaattgaaacaaagaattcttttgtttttcccatttgttgttcttatgatgggaatgatacttacacctgttttatttttgcgcacttaccggcagatagcatttgagcacacttcggcattatgtgaaatcatattggaaaactctcccgaagcagaaccacagctattagcgtccctaaaagactatcaatcattgaccgaacaatcactaagagaaaacaattatctggaaaaatacggataccgtactgatgatttttgcaaaggatttccgccggatacgttcctttttccaattctgctttttcttgtagccgcctgcgcctttgcattcggaatcttacagttccgcaagaaaaatcgaattcggattgctgatttaaccgagtatttggagcaagtcaatattgaggcaggggggacattgatacagacacaggaagatgattattcacatttacaggacgagatatacaaaaccgttaccacactttatcaaactagagaaacggcagttaccgcaaagaaaaactttgcagaaaatttagctaatattgcgcaccagctaaaaacgccgattacggcggcatttttatctttacagattatgaaaaaagaaggaataccagaaatttatgcaattcagattgaaagacagttggaacgattaaatcgtttggaagaatctttcctaatgctttcccaaattgatgctggaacgctcccgctcaaatgggaaaaagttgatctttatacggtgttaaatctggcggccgaaaacctgagcgatctattgcgaagatacaatatttctgttgatattccagaaaatggatgcattgaattttggggggatctggaatggacaatggaagcatttattaatctcttgaaaaattgcatggagcattcccaaccaagcgggacagtccactgcgtctactcaggaaatcctctttatgtagaaattcggatatgggatgatgggactggttttgatacagaggacttaccatatcttttcgagcgtttttatcggggtaaacgtgcagttggaaatggtatcgggattggattggctcttgctcgttctatttttgaattgcaaaatggaatcataaccgcttataatctgcaaaacggtggagcttgttttgaaataaggatatacagtcactgagatgtcactttactttgctatactgcatacaagaccatcaggtagaaaggagaaagtgac
